United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 120

SEQ ID NO: 4245608 - RNA, 130 nt, Pseudomonas putida KT2440
ugguugaugugguugcauguguauaagcugcaagcaacgagcuucacgcugcacgacaaugcagcccggcgcucggccugcuuuuucuugcagcuugaagcuuacggcuugaagcucgacuggacaggaa

SEQ ID NO: 4245609 - RNA, 82 nt, Pseudomonas putida KT2440
gcgccgacgaccguaggcaggugcgccuggcacucaccgccgacggccagcgccuggccaaccgccugccggaaaucggcgc

SEQ ID NO: 4245610 - RNA, 63 nt, Pseudomonas putida KT2440
agcagcgagcgacaagacaagaagccccaaccgcgaccgcuuuucguccugucgccugcugcu

SEQ ID NO: 4245611 - RNA, 105 nt, Pseudomonas putida KT2440
uguucagcugugccggccucuucgcggguaaacccgcuccuacauggccacauauuucccuguaggggcagguuuacccgcgaagaggccaaggcaggcuguaca

SEQ ID NO: 4245612 - RNA, 106 nt, Pseudomonas putida KT2440
cgcugcaaggcggcaaaaccuucauugcgggcgcgugcggcggugaacgggauacucauguccagcgccaguacugccacgccaagguuggcggccaacugcagcg

SEQ ID NO: 4245613 - RNA, 84 nt, Pseudomonas putida KT2440
uucgcgggugagcccgcuccuacacagagacggugcaagguuugaaaccugcgcgguccuuguaggagcggguucacccgcgaa

SEQ ID NO: 4245614 - RNA, 55 nt, Pseudomonas putida KT2440
ggacuacaccaucgcccuggugacccauaacaugcagcaggcgauucguguggcc

SEQ ID NO: 4245615 - RNA, 80 nt, Pseudomonas putida KT2440
gccggccucuucgcggguaaacccgccuaccaggcaacgcguuaccucguaggagcggguuuacccgcgaagaggccggc

SEQ ID NO: 4245616 - RNA, 58 nt, Pseudomonas putida KT2440
augaagacuauaucgaucugaauccgcugauugcggguaucgguacccugggcuucau

SEQ ID NO: 4245617 - RNA, 72 nt, Pseudomonas putida KT2440
ccucugcgcugucuuccggcagcugcguguacaggcugacgcugccuuucagcucgucggaagggcgcuugg

SEQ ID NO: 4245618 - RNA, 85 nt, Pseudomonas putida KT2440
ggccccuucgcggguaaacccgcuccuacacgggucaccgccgggugcggugccugcguaggaacgggucucccgcgaaagggcc

SEQ ID NO: 4245619 - RNA, 102 nt, Pseudomonas putida KT2440
ucugcgccagguauugcacgaccuugcgcauaucggccaagccuaacccuucuucguccugggucaacugguagcgcaggaucaggugcguccaaucgcaga

SEQ ID NO: 4245620 - RNA, 77 nt, Pseudomonas putida KT2440
ggccacuucgcggguaaacccgcuccuacaugcgccugugaugaaccuguaggagcggguuuacccgcgaagaggcc

SEQ ID NO: 4245621 - RNA, 87 nt, Pseudomonas putida KT2440
cuguuacuggcaagucacccaggaggcugccgggcugccggggaaagcuggguuggcagcuuacugcgugacguugcggggccgcag

SEQ ID NO: 4245622 - RNA, 74 nt, Pseudomonas putida KT2440
uauucgcggguaaaccagcuccuacaacguggcgacaccaccggucgauguaggagcgggcuugcccgcgaaug

SEQ ID NO: 4245623 - RNA, 56 nt, Pseudomonas putida KT2440
gcugguugacguccggguacagggauuugaccuugugccggaagcgugcagccagc

SEQ ID NO: 4245624 - RNA, 76 nt, Pseudomonas putida KT2440
ggucacgguguaggugaucacgccgccuucggucacgcuuggcgaggcggucagggucgcaguaguggugucgacc

SEQ ID NO: 4245625 - RNA, 55 nt, Pseudomonas putida KT2440
cgagcgcagcaggcccuuggccggcaggaccgggucgggcgucugguuguucucg

SEQ ID NO: 4245626 - RNA, 124 nt, Pseudomonas putida KT2440
ggcgcuguggaggagggcagccugccugccgaugcccgcuucuucagccaggcgcagcgggcccaugaagccuugcuggacaugcuggacgaaguggcggccgggcaggauauuccaccgcgcc

SEQ ID NO: 4245627 - RNA, 73 nt, Pseudomonas putida KT2440
gcugggcgccgguuacaaauggaaccgguuggaacccaauaccagccgccaugaugucgaccuuaccaaccgc

SEQ ID NO: 4245628 - RNA, 58 nt, Pseudomonas putida KT2440
cgguggcuuguugcugaucgaagcccugcuguugcagaugaccacgccacaggcgcug

SEQ ID NO: 4245629 - RNA, 82 nt, Pseudomonas putida KT2440
uucgcggguaaacccgcuccuacagguauugcgcugcccuugaggcuugcgccguacgugugggagcgggcaugcccgcgaa

SEQ ID NO: 4245630 - RNA, 66 nt, Pseudomonas putida KT2440
aggcgcggguuuaccugcuaaugcggcggugaggcuucuguagcauucgcgggugaacccgcuccu

SEQ ID NO: 4245631 - RNA, 101 nt, Pseudomonas putida KT2440
gccugcgccggccucuucgcggguaaauccgcuccuacaggcgcggaccgugcgcggucccccguaggagcggguuuacccgcgaagaggccggcacaggc

SEQ ID NO: 4245632 - RNA, 58 nt, Pseudomonas putida KT2440
gccugccaaccggccagcaggaccaugaacaggcuggccugcugcuggugggcaaggc

SEQ ID NO: 4245633 - RNA, 74 nt, Pseudomonas putida KT2440
ucggcgaagaucagcucugcgccauggccggugaccuaugggccgucgacgcggcggcugaucgacuuugccga

SEQ ID NO: 4245634 - RNA, 83 nt, Pseudomonas putida KT2440
cgcaagucguuguucgacucgauucagggcuuggaugaacgagcguuuccuguggccuucaacgaugucgauuuaugcuugcg

SEQ ID NO: 4245635 - RNA, 87 nt, Pseudomonas putida KT2440
cugugggagcgggcgugcccgcgaacaccggcgaagccggugccauacaccguggugccugcuucgcgggcaagcccgcucccacag

SEQ ID NO: 4245636 - RNA, 59 nt, Pseudomonas putida KT2440
gcacgcugggcucgucgagcacguaguagcgauaauugugcugaucgagcucggcacgc

SEQ ID NO: 4245637 - RNA, 107 nt, Pseudomonas putida KT2440
agcgugguccaugugggagcgggcgcgcccgcgaacaccggcgcagccggugccaugcaccgcguuggauucuucgcgggcacgcccgcucccacagggucccugcu

SEQ ID NO: 4245638 - RNA, 82 nt, Pseudomonas putida KT2440
cugcugcagcggcgaaggagacgggcgcgugucagucguggucauggucucuccuucgcuuaagccggguacuuugcagcag

SEQ ID NO: 4245639 - RNA, 72 nt, Pseudomonas putida KT2440
agucgcguucguugagguacaggcaguugccgugcugaucggcgaacaccugaaucuccacguggcguggcu

SEQ ID NO: 4245640 - RNA, 63 nt, Pseudomonas putida KT2440
uucgcggguaaacccgcuccuacaagguuuggcgcaucuuguaggagcggguuuacccgcgaa

SEQ ID NO: 4245641 - RNA, 57 nt, Pseudomonas putida KT2440
ucgggagaaauuugccggccuugaugaaacuuaguggcgugcaaauaucucuaacga

SEQ ID NO: 4245642 - RNA, 94 nt, Pseudomonas putida KT2440
ccguggaacgacccgcagcuggcggugguggguucguaccagcgugcgcuggaaaucaugaacauccccaacgccgcguucauggucgaccugg

SEQ ID NO: 4245643 - RNA, 108 nt, Pseudomonas putida KT2440
gccgcgcuccuuguucagcucgaacaacaagucgcugaugcguucgccgguguggcugucgagguuaccggugggcucaucggcgaacagcaccgcaggcugcgcggc

SEQ ID NO: 4245644 - RNA, 56 nt, Pseudomonas putida KT2440
auagcagcggccagagcgcucuauugauaggucaauggagauguagucguuguugu

SEQ ID NO: 4245645 - RNA, 63 nt, Pseudomonas putida KT2440
gggcaacaacgacugugacaugguucagggcuccguaacaucgaagcaccaugcucgcugccc

SEQ ID NO: 4245646 - RNA, 78 nt, Pseudomonas putida KT2440
ggcagcgggcuugcccacgaagcaggcaacgcgcuagauggcacaggcguugccgguguucgcgggcaagcccgcucc

SEQ ID NO: 4245647 - RNA, 74 nt, Pseudomonas putida KT2440
gccuuggcuugcgaucucgcgcaacugccggugggccgguucgucaagguuguccggggucugcacggccaggc

SEQ ID NO: 4245648 - RNA, 59 nt, Pseudomonas putida KT2440
gucgauggcacuggcgguguugagcugcagacggcugccgucacugccuugccauuggc

SEQ ID NO: 4245649 - RNA, 103 nt, Pseudomonas putida KT2440
ccgcccccugugggagcgggcaugcccgcgaauacgucagcagggucaccgucauuaccugauuggucgcauucgcgggcaagcccgcucccacagagggcgg

SEQ ID NO: 4245650 - RNA, 68 nt, Pseudomonas putida KT2440
ccgccgcgguuugcuggugcugcagguuauuagccuggccugcagccacaugcccguaaaccgcgcgg

SEQ ID NO: 4245651 - RNA, 117 nt, Pseudomonas putida KT2440
gaaaucgccgaagucgacggugagcaccaguucgaaguacuggcuaccaacggcgacaccuuccuggguggcgaagacuucgacaugcgccugaucgacuaccuugucgacgaguuc

SEQ ID NO: 4245652 - RNA, 98 nt, Pseudomonas putida KT2440
ccggccucuucgcgggcaagcccgcucccacaggauaggcgccgggcuugaaucuggugccauuccugugggagcgggcuugcccgcgaagaggccgg

SEQ ID NO: 4245653 - RNA, 66 nt, Pseudomonas putida KT2440
gugguugccgaugacacugucguggccaaugugggcauaggccaugaucagguuauggucacccac

SEQ ID NO: 4245654 - RNA, 83 nt, Pseudomonas putida KT2440
gucccuguaggagcggguuuacccgcgaauacgucggugaauccaacaucgcauucgcggguaaacccguuccuacagaggac

SEQ ID NO: 4245655 - RNA, 79 nt, Pseudomonas putida KT2440
ugcgcaacugcucgucggugaugaucucgaugucugggccuucgcccucgaugcgcaggucuucgccgaucagcgugca

SEQ ID NO: 4245656 - RNA, 86 nt, Pseudomonas putida KT2440
gccugcugucgguggucgcgcaacugucgcugagccuggguguggccugcgccggcgcacuguugggcggcuuuacugcggcaggc

SEQ ID NO: 4245657 - RNA, 67 nt, Pseudomonas putida KT2440
ggcaggacuacgacaucaacgacuacgggcugaucaagcagcccaagcucagcauugucuauucgcc

SEQ ID NO: 4245658 - RNA, 98 nt, Pseudomonas putida KT2440
cuggcccuuucgcgggugaacccgcuccuacgggggcugcacaccauuggaaccugguggugaccguguaggagcggguuuacccgcgaagaggccag

SEQ ID NO: 4245659 - RNA, 59 nt, Pseudomonas putida KT2440
aucggcuuggcgaugcguguggaggaguucaagcccaucaccaacgcggccauguugau

SEQ ID NO: 4245660 - RNA, 80 nt, Pseudomonas putida KT2440
cggcaucggugcggaacugcgcgccaaggcucaggaacagcugcugggccaugguguuguugcuguacuuguugaugucg

SEQ ID NO: 4245661 - RNA, 71 nt, Pseudomonas putida KT2440
guggggcgccaucaagguggcugggggcgugugaacuauguucguacucagcuugauguauucgacccuac

SEQ ID NO: 4245662 - RNA, 62 nt, Pseudomonas putida KT2440
ccagcagcagcgccugugcaucgcccgugccaucgccaccgagccggaagugcuguugcugg

SEQ ID NO: 4245663 - RNA, 129 nt, Pseudomonas putida KT2440
gagcacaucaaccacuauggcucgcaccacaccgacucgaucaucagcgaacaccagggugaagcccgucaguucauggcugaggucgauucggcgucggucaugcucaacaccccgaccugcuuugcc

SEQ ID NO: 4245664 - RNA, 63 nt, Pseudomonas putida KT2440
guccuguuccaaugcuucgcccaaagccugcaagucguauucggcggagcagaagaacaacac

SEQ ID NO: 4245665 - RNA, 118 nt, Pseudomonas putida KT2440
gccgacgccgccuuuuguaggagcggguuuacccgcgaaggcgucgguccuggcaaucgagguugucgcugccgacgcauucgcgggugaacccgcuccuacaagggaccgugucggc

SEQ ID NO: 4245666 - RNA, 70 nt, Pseudomonas putida KT2440
gcacgccugcgcggcaagccuggccuguuccgcgucgaacugaacggcgagcgcauugccgccaucgugc

SEQ ID NO: 4245667 - RNA, 57 nt, Pseudomonas putida KT2440
gguguaaugucguggagcuuucucgaggcuuguuggugaaguucggcagcuugcgcc

SEQ ID NO: 4245668 - RNA, 102 nt, Pseudomonas putida KT2440
gugguggugcacagcgagcugguccgccauggcgaagcgggguucagcuucuucagcuuuaccccguucggccugguggugcugguacugggcauuggcuac

SEQ ID NO: 4245669 - RNA, 59 nt, Pseudomonas putida KT2440
cgauacaccgccugugccucugcggccggcagcggcugcgagggacgugggguguauug

SEQ ID NO: 4245670 - RNA, 91 nt, Pseudomonas putida KT2440
accaguuguggcucgaucugcugcagggcuuggcgcagaucagucagccggguaaccucgcgcagaucgaucccaaccugccgaugcuggu

SEQ ID NO: 4245671 - RNA, 58 nt, Pseudomonas putida KT2440
ggcauguaacaguuggucguugcccccggccugggcggcgaucuggauguugcaggcc

SEQ ID NO: 4245672 - RNA, 59 nt, Pseudomonas putida KT2440
cguggguggcggcagcgcgauggaugcggccaaggccaucagccugcugcucacccacg

SEQ ID NO: 4245673 - RNA, 80 nt, Pseudomonas putida KT2440
ccggccucuucgcgggcaagcccgcuccuaaagggguaacacgaucauuguaggagcgggcuugcccgcgaaagggccgg

SEQ ID NO: 4245674 - RNA, 65 nt, Pseudomonas putida KT2440
gccaauacucgaggucacagucgaucaagugcccaugcuggucgcuguugacccggguaaugugc

SEQ ID NO: 4245675 - RNA, 91 nt, Pseudomonas putida KT2440
cgccaaggcaugaacauuccgcuggacugccgcgacggcgcuugcgggaccugcaagugcaaggcugaguccggucguuaugaccuuggcg

SEQ ID NO: 4245676 - RNA, 110 nt, Pseudomonas putida KT2440
gccugguagggccauugcgcaaacacuaugaacugacaggccuggugguguucggcaaugccgagccacagcgccuggucgccaaucagaugaugcauggccccaccggc

SEQ ID NO: 4245677 - RNA, 59 nt, Pseudomonas putida KT2440
gguggccugcugaaaaugccacgccucaacggaggugcgcgcauucgucacaggucacc

SEQ ID NO: 4245678 - RNA, 93 nt, Pseudomonas putida KT2440
ggccuguucgcgggcaagcccgcucccgcagguuuuucacgaugcugaaccgugugagaacccugugagagcgggcuugcccgcgagagggcc

SEQ ID NO: 4245679 - RNA, 89 nt, Pseudomonas putida KT2440
gugcgcaguaauggugcgcuggucuucgccacggugggugagugccacauagaucagcccaccggcauugaucacguagucaggugcau

SEQ ID NO: 4245680 - RNA, 77 nt, Pseudomonas putida KT2440
uugacggccucuucgcggcuaaagccgcuccuacggggaccgcguaggcgcggcuuuagccgggaaagggccgucga

SEQ ID NO: 4245681 - RNA, 75 nt, Pseudomonas putida KT2440
guaggcacguugcgccuggccacccugccaaccuucgguucgaaauggcuguugccgaggcugcaugcguucuac

SEQ ID NO: 4245682 - RNA, 57 nt, Pseudomonas putida KT2440
cuugcaugauucggcuauucaucauugguuuuugcggguggauggcucgucaucgag

SEQ ID NO: 4245683 - RNA, 78 nt, Pseudomonas putida KT2440
gaagcgccauugcccggucuuggccauguaggcgugcuggucgugcagguccauggccagcgagugggcauugccuuc

SEQ ID NO: 4245684 - RNA, 56 nt, Pseudomonas putida KT2440
cuucgcgggugaacccgcuccuacggggaccugcagcagcggguuuacccgcgaag

SEQ ID NO: 4245685 - RNA, 113 nt, Pseudomonas putida KT2440
uggcgcgauuuuggacugugggagcgggcuugcccgcgaacaccggcgaagccggugccaugcaccgcgucgcuuguuucgcgggcacgcccgcucccacagguaaagcguca

SEQ ID NO: 4245686 - RNA, 56 nt, Pseudomonas putida KT2440
aucgcgaagcccgccuggcggcccuguuucacgaguugccgggcaugcuuggcggu

SEQ ID NO: 4245687 - RNA, 75 nt, Pseudomonas putida KT2440
gggcgugcguaaccuggcugguuucaaccgcaagaucaaggacgcccaggaagccggcgaaguuauccaugaccc

SEQ ID NO: 4245688 - RNA, 56 nt, Pseudomonas putida KT2440
cggcgcgggcaaacugguugaucaugcuaucggugaacagguagaagcucgcgccg

SEQ ID NO: 4245689 - RNA, 73 nt, Pseudomonas putida KT2440
ugcaccaccaaggucgauuucguccagcgcaccgccgaaccgcgugacgaagucaaaggccugguggcccgca

SEQ ID NO: 4245690 - RNA, 85 nt, Pseudomonas putida KT2440
ugcucgaccugucggccuggcaacuggucggcaucacucuguugaugacccacgugaccauugucagcgucacggucuaccugca

SEQ ID NO: 4245691 - RNA, 129 nt, Pseudomonas putida KT2440
cuuuuuugugggagcggccuugugucgcgaaagggcugcgaagcagccccggcacucugugcugcgaagcugaaaucccggggccgcuucgcgccccuuucgcgacacaaggccgcucccacaaaaaag

SEQ ID NO: 4245692 - RNA, 90 nt, Pseudomonas putida KT2440
agaucuugcccaaugacaggcgugggcugaacucgccguaguagguggucacaccuuugccggggucggccuugccguuguagaagaucu

SEQ ID NO: 4245693 - RNA, 56 nt, Pseudomonas putida KT2440
gucgcacaggaccaggucgaacgcuuccuugccgagcauggccauggccuugcgac

SEQ ID NO: 4245694 - RNA, 67 nt, Pseudomonas putida KT2440
ucgggaugagcgaccugugggaagucgagaggcaccucacugacacuuuccgucggguguucaccga

SEQ ID NO: 4245695 - RNA, 99 nt, Pseudomonas putida KT2440
ggcaggggaaaaaccucgagcgguucuugcagugucggcacgccgacauggugguggcguugccguaccugcacagggccuugcaaggcaaacccugcc

SEQ ID NO: 4245696 - RNA, 122 nt, Pseudomonas putida KT2440
gcgguucuccugugccggccucuucgcggguaaacccgcuccuacaggauggccgcaggcccaaacauugugcgccccccuguaggagcggguuuacccgcgaagaggccggcacagaccgc

SEQ ID NO: 4245697 - RNA, 69 nt, Pseudomonas putida KT2440
gcgccauugaucggcacaaacgaaaacgcccggcucaaggccgggcguuuugcauugccgaucaggcgu

SEQ ID NO: 4245698 - RNA, 70 nt, Pseudomonas putida KT2440
ggcuucggugaguuucuuagaaucguucagaccgagaaucggccgugcaggaucaagaaucaccgccgcc

SEQ ID NO: 4245699 - RNA, 70 nt, Pseudomonas putida KT2440
uggcacgaucucggcgcccagcagcuucaugcggaacacguucgccugcuggcgcucgaugucgguggca

SEQ ID NO: 4245700 - RNA, 58 nt, Pseudomonas putida KT2440
gggccugcagccaguucaagccuugcugcugauaagggcgcaagcuggccugcagccc

SEQ ID NO: 4245701 - RNA, 60 nt, Pseudomonas putida KT2440
gccgcuguuggaugucaugcagaccuuaccaaccuucgucuaccugauuccagcgguggc

SEQ ID NO: 4245702 - RNA, 98 nt, Pseudomonas putida KT2440
gcuggcuaacggcguguugauguaugcccgccauaucgaccagcuggagcaacugggcggccuggucgggcagaucaucaacaagcauguugcccugc

SEQ ID NO: 4245703 - RNA, 102 nt, Pseudomonas putida KT2440
gcgcccagguggccaaguaucccauugcuggcggugagcggcugagugacagccugauucaccucaccgccaucgcugauggcccggccgcguucugggugc

SEQ ID NO: 4245704 - RNA, 81 nt, Pseudomonas putida KT2440
gggaggccaggauagagccgucuuugaucuucuggcccagcucgcccacggucauggagucggcuguguccugggccuucu

SEQ ID NO: 4245705 - RNA, 92 nt, Pseudomonas putida KT2440
acggcaugucauuauucuugucuccaauaagccucauggaccgugugcaacacgguugccauggauuauuggaaacggauguaaggcgccgu

SEQ ID NO: 4245706 - RNA, 100 nt, Pseudomonas putida KT2440
ccuggaaauauuuuugcuguggcggccucuucgcggguaaacccgccccuacgggggguuuacccgugaagaggcuggcacaggcaacuaccgaaccagg

SEQ ID NO: 4245707 - RNA, 60 nt, Pseudomonas putida KT2440
ggugguacagcggcgaagcgaugcugcgcugcgucaucccgcugcugccgcuuuacuacc

SEQ ID NO: 4245708 - RNA, 57 nt, Pseudomonas putida KT2440
uccuggcuuugcggcgugguucgaccgcguaagccuaagcaaugccgcagggcagga

SEQ ID NO: 4245709 - RNA, 59 nt, Pseudomonas putida KT2440
gccgacgaagcgguuggggaaauugucgagcaggcgguccagcgcacgcuccgucuggc

SEQ ID NO: 4245710 - RNA, 59 nt, Pseudomonas putida KT2440
uugcgggcaagaccgcgccugcaagggguuaccacuugcaggcgcggguuuacccgcga

SEQ ID NO: 4245711 - RNA, 86 nt, Pseudomonas putida KT2440
guuucgagccggcguacggcuuccucgagugcgucagcgacgaaaaaacgugauguuucgagcaggagccuugccgucuucgaaac

SEQ ID NO: 4245712 - RNA, 64 nt, Pseudomonas putida KT2440
gccgcaucgccauuugagcgccgacaaggcugaaaccuugauagcgcucaaggggcguuuuggc

SEQ ID NO: 4245713 - RNA, 78 nt, Pseudomonas putida KT2440
gggcauacacccuaccggcaggcaggucagcgugcaggcacgccauuaccuccuggccgguggcgguaucaacagccc

SEQ ID NO: 4245714 - RNA, 81 nt, Pseudomonas putida KT2440
ccaggucgaacagccgugggucggugaacaucucccgcuugcagcgguagaugcccuuuucacggucguccucgagcaugg

SEQ ID NO: 4245715 - RNA, 102 nt, Pseudomonas putida KT2440
gccaagauaggucgaaagccguucggccaaggcuucuauacccggcauggguucaccuccugccgaggaagagggccuugcgccguacgacgucgaccuggc

SEQ ID NO: 4245716 - RNA, 95 nt, Pseudomonas putida KT2440
uugccugugccggccucuucgcggguaaacccgcuccaacagggaucgcaccgagguaggagcggguuuacccgcgaagaggccggcacaggcaa

SEQ ID NO: 4245717 - RNA, 69 nt, Pseudomonas putida KT2440
ugucgacgcguauccugccggcaccuagcgcagugguaagcgcuggcgucgagcuggugcgcagcggcg

SEQ ID NO: 4245718 - RNA, 61 nt, Pseudomonas putida KT2440
ggucaccgcaaucagggcgaacacgccgaucggggcguaguucaugaucaugugggugacc

SEQ ID NO: 4245719 - RNA, 68 nt, Pseudomonas putida KT2440
cgacuggcgccugcaccuggcggcguccaagaacuggucggacuucgccaugcaaggcgccguguucg

SEQ ID NO: 4245720 - RNA, 78 nt, Pseudomonas putida KT2440
cgggugcuggcagggcugcagcagccuggcggcggcagcgugagcuugcacggccagccgcugcaggggccgcacccg

SEQ ID NO: 4245721 - RNA, 60 nt, Pseudomonas putida KT2440
ggcucaccgaagcguuccagugacagcggcugcacgugauacugaagguuggcgguggcc

SEQ ID NO: 4245722 - RNA, 58 nt, Pseudomonas putida KT2440
ugcggugguuucgacccgcaggccuucgaaaagaaccgcgccaucgaagaucgccgca

SEQ ID NO: 4245723 - RNA, 58 nt, Pseudomonas putida KT2440
gguguuuuugauuucgccguucgugggccguaucuacgacugguacaagaagagcacc

SEQ ID NO: 4245724 - RNA, 95 nt, Pseudomonas putida KT2440
agcuuuacugguauugguacuuggcagucuuugcggcgcggcaauggccggcgaagccaaagaugccgagcagauuccgguugaacaguacaguu

SEQ ID NO: 4245725 - RNA, 60 nt, Pseudomonas putida KT2440
ccucacugccgguuccuuguucggucgcucugaaagugcgaccggcaaaggccggcgagg

SEQ ID NO: 4245726 - RNA, 69 nt, Pseudomonas putida KT2440
uucauucccguggugacccgugaacaacacccuggggcguugaaucagcgcauuaccacguugaucgag

SEQ ID NO: 4245727 - RNA, 78 nt, Pseudomonas putida KT2440
cgcucgcccuuguagugcuccaggucguccgccuucaaagacaggguacgcuugccggccugcaauacaagggucgcg

SEQ ID NO: 4245728 - RNA, 83 nt, Rickettsia prowazekii
gauuucaaaugauaguucauaguuuuacuaagauucacgcuauuauccugagagucuacuagaaacuuugaagcuuuggaauc

SEQ ID NO: 4245729 - RNA, 66 nt, Rickettsia prowazekii
ggagggccggcauaugauaacgguguuacaagaguacuugucucaucuauuauauugcuaccuucu

SEQ ID NO: 4245730 - RNA, 81 nt, Rickettsia prowazekii
uuuuacauggauuuuuuauaauuuguccauuaccuuggcauuuauggcaaguuuguucaagugugaagaauccuuguugaa

SEQ ID NO: 4245731 - RNA, 130 nt, Rickettsia prowazekii
auuuaucgguaguggauauguuggauuaguuucagguauuauuaugggauauuuaggucauaaugugacuugucuugauaaugaugauguuaagauauccaaauuaaauaagaaaauauuaccgauuuau

SEQ ID NO: 4245732 - RNA, 58 nt, Rickettsia prowazekii
ggcucaagccuuaguuguagcauugcauauaauaaccuacgauguacagguuugaguc

SEQ ID NO: 4245733 - RNA, 66 nt, Rickettsia prowazekii
ucguagucauaccguggcugcucagggugguauuagugcugcucuuggcaauaugggugaagauga

SEQ ID NO: 4245734 - RNA, 73 nt, Rickettsia prowazekii
aaucuauuaacaguaaauuguuggaaaauuuaaucaaggcagguuguuuugaugaguugcaugauaauagauu

SEQ ID NO: 4245735 - RNA, 62 nt, Rickettsia prowazekii
ugcucaggcuguaagugcaccuguaacuagucguauaagugcaggaacagaacaggcuagua

SEQ ID NO: 4245736 - RNA, 67 nt, Rickettsia prowazekii
aucacagguaagguuguuacaauguuagaucugauugcaguaucaaguguuuuauaacuccuguggu

SEQ ID NO: 4245737 - RNA, 57 nt, Rickettsia prowazekii
uguaugaaccacgggaucuaauauuguuacuuuuauuggcucccgugguuucauaua

SEQ ID NO: 4245738 - RNA, 64 nt, Rickettsia prowazekii
aucuuugaauagcuaagguuuuuguguaguucuuuuauuuagagauuacuuaguauucauagau

SEQ ID NO: 4245739 - RNA, 82 nt, Rickettsia prowazekii
cucaaugauuuuagguauuagugguauuagaucugcauaucuuacugguagagguaguaucauuaugcgugguaaagcugag

SEQ ID NO: 4245740 - RNA, 81 nt, Rickettsia prowazekii
uauaauuaauuaauaaacccucuucacugguggaauugcacuaauugcaucgguuaaagugguuaauguuacagguuuaua

SEQ ID NO: 4245741 - RNA, 63 nt, Rickettsia prowazekii
agacuugguaaaagucguagucauauagcuaauuuguuaagacuuaauaauuuaccgcagucu

SEQ ID NO: 4245742 - RNA, 70 nt, Rickettsia prowazekii
caaugcauuuuuuagauaguuaauaucuaauacacaaguacuagauucuuucuguguaaagagguuauug

SEQ ID NO: 4245743 - RNA, 61 nt, Rickettsia prowazekii
accugcuauuuuagcugcaagcauuaucuccccucuugcugcaucauuaaaaugugcaggu

SEQ ID NO: 4245744 - RNA, 70 nt, Rickettsia prowazekii
gucaacgucaaagaauuaucauagcaagagccaucuuaaaaaaugcuccuauuuuaauucuugaugaagc

SEQ ID NO: 4245745 - RNA, 78 nt, Salmonella enterica enterica serovar Typhi
gccggauggcgacguguuacgccuuauccggccuacagguauauccccguaggccugguaagcgaagcgccgccgggc

SEQ ID NO: 4245746 - RNA, 64 nt, Salmonella enterica enterica serovar Typhi
guaguucuucguaagccgucaugauuacaaucucacaucugacugcucagccggaagaacauac

SEQ ID NO: 4245747 - RNA, 61 nt, Salmonella enterica enterica serovar Typhi
gguacugccagaggucugacggaucccuuugcgaauaacauccucaacuucagcagauacc

SEQ ID NO: 4245748 - RNA, 59 nt, Salmonella enterica enterica serovar Typhi
ugaguguggcggugaagcugcccguaccgucggcgguggcgguucccaguaccacacca

SEQ ID NO: 4245749 - RNA, 71 nt, Salmonella enterica enterica serovar Typhi
gcgccgcgcgguaugccgcagaucgaagucaccuucgauaucgaugcugacgguauccugcacgucuccgc

SEQ ID NO: 4245750 - RNA, 79 nt, Salmonella enterica enterica serovar Typhi
agcuggcgcgcaaccaucggcuggcggagcgucuucuggagaccgaagagagcguacggcgcgauguugcgcgugagcu

SEQ ID NO: 4245751 - RNA, 70 nt, Salmonella enterica enterica serovar Typhi
cgguuagggaugguucgacaauggcagcaacuguuuuuccaggagcgauauagcgaaaccacccugaccg

SEQ ID NO: 4245752 - RNA, 55 nt, Salmonella enterica enterica serovar Typhi
uccauaaugaccucuuauuucccguaaccuugcgaggggguaaagguauugucga

SEQ ID NO: 4245753 - RNA, 74 nt, Salmonella enterica enterica serovar Typhi
guuuguacgcauauggcggaucuggauuacggugacuugcgcgucuauccggguaacuaugaugaguauaugac

SEQ ID NO: 4245754 - RNA, 85 nt, Salmonella enterica enterica serovar Typhi
uugccggauccuaaagugaauggcaaugcgggcagcuuuuuuaaaaaucccguugucgcagccgauaucgcuauggaacuguuag

SEQ ID NO: 4245755 - RNA, 75 nt, Salmonella enterica enterica serovar Typhi
agcgauuccgacuucauggagucgaguugcagacuccaauccggacuacgacgcacuuuaugagguccgcuugcu

SEQ ID NO: 4245756 - RNA, 77 nt, Salmonella enterica enterica serovar Typhi
uaugagcguaucaagucugaagcgaaaacuggccgcugaagaggugaguuuuagcaaaauauacuuggaugcucgua

SEQ ID NO: 4245757 - RNA, 56 nt, Salmonella enterica enterica serovar Typhi
uccauuggugguacugagcugcugcuguuuaagcagaugggcaaagccacggugga

SEQ ID NO: 4245758 - RNA, 81 nt, Salmonella enterica enterica serovar Typhi
uucaacuuccaggcgauuacgcgcgaacgaagucgaugugagucagcuucgguuuguaagcgugacgcuguacagccugag

SEQ ID NO: 4245759 - RNA, 57 nt, Salmonella enterica enterica serovar Typhi
acaccgcaaaccguaauauucgccucguucccagcgggaacaucacggagcgguagu

SEQ ID NO: 4245760 - RNA, 67 nt, Salmonella enterica enterica serovar Typhi
auggaaccagagauugcuaggugacugucuuuuuuuaauagcauuucaccgucgaucguuugcccau

SEQ ID NO: 4245761 - RNA, 71 nt, Salmonella enterica enterica serovar Typhi
cgcuugaucccgcgacgacccguucgauucuggaauugcugaaagauaucaaccgucgucugggguugacg

SEQ ID NO: 4245762 - RNA, 57 nt, Salmonella enterica enterica serovar Typhi
ugaaguuuaucaaaggugacgcuauugccggcaucauuaucaucuuugugaacuuua

SEQ ID NO: 4245763 - RNA, 58 nt, Salmonella enterica enterica serovar Typhi
gauggugaugaccgucaaugccucgguauugauuccgggccaugacaucuauccuauc

SEQ ID NO: 4245764 - RNA, 130 nt, Salmonella enterica enterica serovar Typhi
ugauugccgccaucuuuacccugagccuugcgggauacaugcccgucugggagccgcugcucauuuaugcgcugggcacgcuaugguacggcguguuuaacugguuuugguucugacuauggcgcgaaca

SEQ ID NO: 4245765 - RNA, 91 nt, Salmonella enterica enterica serovar Typhi
gucaaacccacagcaguagcaccagcaaaacccgcuccagcagcgucgguuucagcgucggggggccuguuggugcuagcauaggguugau

SEQ ID NO: 4245766 - RNA, 87 nt, Salmonella enterica enterica serovar Typhi
gcggcguuucgucgccccacggucugucccagucggcgcuguagagacgcugcacgcccuggaacagcaggcgguuggguucgccgu

SEQ ID NO: 4245767 - RNA, 73 nt, Salmonella enterica enterica serovar Typhi
gcguaugccgggucggugccuucugccaccagcuugucgaagcacagcagagaaccggccugcagcauaccgc

SEQ ID NO: 4245768 - RNA, 78 nt, Salmonella enterica enterica serovar Typhi
gccugauggcgcuacgcuuaucaggccuacagguugcagaaacguguaggccggauuaggcgcuagccgccauccggc

SEQ ID NO: 4245769 - RNA, 60 nt, Salmonella enterica enterica serovar Typhi
cgccagccacucgccauaggcuuucgcaugacuggccagcgucugcggcgacuggcggcg

SEQ ID NO: 4245770 - RNA, 91 nt, Salmonella enterica enterica serovar Typhi
guugacgaagguggguagcgauaaccugcugaugaucaaugcgcaugucgcacaugauuguacgguagguaaucgcuguauccucgccaac

SEQ ID NO: 4245771 - RNA, 67 nt, Salmonella enterica enterica serovar Typhi
gcgucauucuuacccggcgauagucugcugcuacuggcaggcgcguugaucgcccaggaugugaugc

SEQ ID NO: 4245772 - RNA, 64 nt, Salmonella enterica enterica serovar Typhi
aucaccguauuggcgccgcugguaugaaccugaacaaaguuaccuagcgucgccgccuggugau

SEQ ID NO: 4245773 - RNA, 57 nt, Salmonella enterica enterica serovar Typhi
uccuccuuuuucgucuggcugaacuaucuuuaggacaggcaagggaagaagugagga

SEQ ID NO: 4245774 - RNA, 77 nt, Salmonella enterica enterica serovar Typhi
guuuuuuacccgauggauuucaugucgacgcaagggcaagucauuccccuugcgucaugaaaacgacggguaaucac

SEQ ID NO: 4245775 - RNA, 61 nt, Salmonella enterica enterica serovar Typhi
uuuuugauugcaucagccugggcgcggaaguccaucccgcgccacuggugacgcucaagaa

SEQ ID NO: 4245776 - RNA, 101 nt, Salmonella enterica enterica serovar Typhi
gaaucauuugcguggaugaugugggauucaguaauauugaugagcgcgugggguauuuauggcguuguauuauugagguuaauugucggcgcauuugauuc

SEQ ID NO: 4245777 - RNA, 63 nt, Salmonella enterica enterica serovar Typhi
gcgcgacgcaaagaguacuggauguuuauucuggucaauaucaucuuuaccuuuguguugggc

SEQ ID NO: 4245778 - RNA, 102 nt, Salmonella enterica enterica serovar Typhi
acgguugcggcuggugaaguucgcccgguaggucgaugcggagugcugguuaggcgucugcauccccacgcgggugacaaaguucucguagccgucggccgu

SEQ ID NO: 4245779 - RNA, 55 nt, Salmonella enterica enterica serovar Typhi
gcgcgcaugauuauucccgccgcgguaaucccacgcgugaugugguucagcgcgc

SEQ ID NO: 4245780 - RNA, 63 nt, Salmonella enterica enterica serovar Typhi
guaucuguucgcauggucaacuucuauccgcgaaagcggcuggguuggcuuuguggaagcugc

SEQ ID NO: 4245781 - RNA, 72 nt, Salmonella enterica enterica serovar Typhi
augaaucacgccgucacgcguguugccguguaguuccguugcggcgauuugcggcggcgugaagccuuucau

SEQ ID NO: 4245782 - RNA, 86 nt, Salmonella enterica enterica serovar Typhi
cacgcccagcgccgccaauaucguugcuuaugccgaaauugugcgcgaguacagucguaagcgacggcugguuaagcuggggcaug

SEQ ID NO: 4245783 - RNA, 57 nt, Salmonella enterica enterica serovar Typhi
ggcggaauuauugucgucaugcaaaccuuacuguucaucacggccuuuauuuucgcc

SEQ ID NO: 4245784 - RNA, 56 nt, Salmonella enterica enterica serovar Typhi
cggcgacgcugucguugagcuacaucccgaugaugagcuggguggcggugucgccg

SEQ ID NO: 4245785 - RNA, 66 nt, Salmonella enterica enterica serovar Typhi
gauuuggcggcaauggcgauagauuucgucugguuggcgauuucugucaccuguugcuguucgauc

SEQ ID NO: 4245786 - RNA, 55 nt, Salmonella enterica enterica serovar Typhi
cguuaccaccaugaugguaaucaucaucaugauggucgucgucaugguggugaug

SEQ ID NO: 4245787 - RNA, 97 nt, Salmonella enterica enterica serovar Typhi
gucauaucgaacgaauuuucauuauaaugaacggaacagauuugcuuuacaagacgaacauuucguucguuauagugaacguuggaugcuuuaugac

SEQ ID NO: 4245788 - RNA, 63 nt, Salmonella enterica enterica serovar Typhi
cgauaauguguugacggauacugucaaaaauuucguuagcgguuuuuccgucgaucauuauug

SEQ ID NO: 4245789 - RNA, 82 nt, Salmonella enterica enterica serovar Typhi
gccgcugacuaccgccugguaaucgguuuucauuucauaaggcgggucaaugagaaucagaccgcggcgggaaaccggcggc

SEQ ID NO: 4245790 - RNA, 58 nt, Salmonella enterica enterica serovar Typhi
cggcgugacagacaccuaucaggcgacgcaaggcgcggauggcuggaccuucacgccg

SEQ ID NO: 4245791 - RNA, 77 nt, Salmonella enterica enterica serovar Typhi
gcuccagcagccugcugccggaaaugucugcggagucgaauccguuccguaaccgucuggcggagucugaggcgagc

SEQ ID NO: 4245792 - RNA, 69 nt, Salmonella enterica enterica serovar Typhi
guauuaaucaguuggcuggccgccgggaaggugucaacgcgaauccggcuuuuggucugcugaucaaac

SEQ ID NO: 4245793 - RNA, 129 nt, Salmonella enterica enterica serovar Typhi
agauauuagucauccgucauuacgucaguuacuggaguucaaaccguuauuaauuaaaccaaaugaugaagagguuaaagcaauauucgguuuaacugucucugacgacaaugaugcgaaaaauacucu

SEQ ID NO: 4245794 - RNA, 70 nt, Salmonella enterica enterica serovar Typhi
gccgacaguuugacgccgcgcggcagaauauugcgguauucgcaaaauucgcgcaucgcgucgagcaggc

SEQ ID NO: 4245795 - RNA, 55 nt, Salmonella enterica enterica serovar Typhi
gaaauucccaauccgagcgcggcgauuaucgccugccugcugauggggaaauuuc

SEQ ID NO: 4245796 - RNA, 88 nt, Salmonella enterica enterica serovar Typhi
gcugccaaagccguacuucuucaugucgaaauuuucaagaauauugaggauuugcacgaugugaauaccgcccgaggacggcggcggc

SEQ ID NO: 4245797 - RNA, 79 nt, Salmonella enterica enterica serovar Typhi
ugggcaauaacgccguggaaaagcucggggcguucguugauagcgacgcccauuagcauuccgcccgcgcucccgccca

SEQ ID NO: 4245798 - RNA, 55 nt, Salmonella enterica enterica serovar Typhi
ugcucucucacgucggccaggcgcccugcgcggugccgguugucgaugaagaaca

SEQ ID NO: 4245799 - RNA, 130 nt, Salmonella enterica enterica serovar Typhi
cuuugucggcgcgaugaugggcauagggccgcuggagauggucacggcgauagaaaacggaauaggcgguacgcucgguuuucuggccgccguuaucggucuuggcaccauccucggcaaaaugauggag

SEQ ID NO: 4245800 - RNA, 74 nt, Salmonella enterica enterica serovar Typhi
uugccguuccagucgguuuuuauccagcgagucggagucccgguccuggcgaucaaaaccguagccugcgguaa

SEQ ID NO: 4245801 - RNA, 65 nt, Salmonella enterica enterica serovar Typhi
ugccugcauaagcugauggaugaagauacagaugaaaucuacuucaccaacguggcgugcaggca

SEQ ID NO: 4245802 - RNA, 62 nt, Salmonella enterica enterica serovar Typhi
cgggcugcgcgaguauuucgaucugcuggugauuuccgagcagguuggcgucgcgaagcccg

SEQ ID NO: 4245803 - RNA, 74 nt, Salmonella enterica enterica serovar Typhi
agaaaauugugugaauggaaaaacguacgaauucuggaagcagaauguugcgcagaucauauucacaugcuucu

SEQ ID NO: 4245804 - RNA, 71 nt, Salmonella enterica enterica serovar Typhi
gccaacaugaccucgauugcuggcgguacguuuaauggugaaagugccgucgccauuggugucuccauggu

SEQ ID NO: 4245805 - RNA, 77 nt, Salmonella enterica enterica serovar Typhi
uagaacaacauccgcugcgcauugguuuaucgacgcuggucaccguggauaccgcuaaucgcgacggucagguacug

SEQ ID NO: 4245806 - RNA, 57 nt, Salmonella enterica enterica serovar Typhi
gcagcaaucgcaagcggaagcgcgcgccaacgacgcgcuggccgaugcgguucgcgc

SEQ ID NO: 4245807 - RNA, 69 nt, Salmonella enterica enterica serovar Typhi
gccaaagaccuugcgggucgugacgugguggcgcguuccaucaugaucgaaauccgugaaggucgcggc

SEQ ID NO: 4245808 - RNA, 82 nt, Salmonella enterica enterica serovar Typhi
ggcaugaucuuccgcaucuucgaagaagaagaaggaguggauaugcaguccgucuucgucuucaaagaagcgcgcggaugcu

SEQ ID NO: 4245809 - RNA, 68 nt, Salmonella enterica enterica serovar Typhi
auaaugugagagauauuggauuuuacuuauugauuuauaagaaaaaacuucgaaauuucuugcgucgu

SEQ ID NO: 4245810 - RNA, 103 nt, Salmonella enterica enterica serovar Typhi
ggcauaaagauauuuucgugacagccaucacuauggcguaaaacaauugcacucguuuaccauuaaaaagugaugugcaucacaauaaauaaucaauaucgcc

SEQ ID NO: 4245811 - RNA, 87 nt, Salmonella enterica enterica serovar Typhi
cagcgcgaacuccagcagcaggaugccgaaagcccguuaaugauugaugaaagccgcuuucaggccuccuggugugguaaagcgcug

SEQ ID NO: 4245812 - RNA, 91 nt, Salmonella enterica enterica serovar Typhi
uugccggauggcgacgcaaugcgucuuauccggccuacggauugauacggauugauguuguaggccugauaagcgaagcgccgucaggcag

SEQ ID NO: 4245813 - RNA, 73 nt, Salmonella enterica enterica serovar Typhi
ggccagcgucacggccugauuccccagcauuguucccugaaacggacuguagggaucggggugcgcgcuggcc

SEQ ID NO: 4245814 - RNA, 70 nt, Salmonella enterica enterica serovar Typhi
gccauugugucucugucuccaauugcacaacgauuuccggcucugccuuuggggacaagagccacauggu

SEQ ID NO: 4245815 - RNA, 71 nt, Salmonella enterica enterica serovar Typhi
gcggcaacacgaugagaaugcugggagaagacuauggcguuucuuauacccauuuucgucguuugugcagc

SEQ ID NO: 4245816 - RNA, 69 nt, Salmonella enterica enterica serovar Typhi
aaacgcuuuuucgaaaggcagaaaagccaacaccauauggguggaucugccuauuuugaaaacgcguuu

SEQ ID NO: 4245817 - RNA, 64 nt, Salmonella enterica enterica serovar Typhi
gcggacaagauggcauagccgucaucgaaggaugucgauuuaaugacgguaacauuuuguuggc

SEQ ID NO: 4245818 - RNA, 72 nt, Salmonella enterica enterica serovar Typhi
gcguaguuugcaaaaugccguugccgauuccagcgaccggaauagugggccggccaguuuuccauauaacgc

SEQ ID NO: 4245819 - RNA, 78 nt, Salmonella enterica enterica serovar Typhi
ggcuauacgccggaguccguugaagagaucacuggcgugagcgcacaggagauucgucaggcggcgcggauguaugcc

SEQ ID NO: 4245820 - RNA, 64 nt, Salmonella enterica enterica serovar Typhi
aacucuuauaugacuuagcgcgcgcucguauccccgccacgccugcccgcuuuauguagugguu

SEQ ID NO: 4245821 - RNA, 59 nt, Salmonella enterica enterica serovar Typhi
cccguccguggaugcuggauaaauauuucgaugccucgcauuuucgcaucguggagggg

SEQ ID NO: 4245822 - RNA, 113 nt, Salmonella enterica enterica serovar Typhi
ugccgcagaaaauagcgccuggcaucaguggucgcuggacgccauccugcaacguuucgccgacugcugcaggucacucuccagcgcccugucggaguguguuguucgcggua

SEQ ID NO: 4245823 - RNA, 58 nt, Salmonella enterica enterica serovar Typhi
gacuucauggagucgaguugcagacuccaauccggacuacgacgcacuuuaugagguc

SEQ ID NO: 4245824 - RNA, 66 nt, Salmonella enterica enterica serovar Typhi
uucauuacuuugaauggcggaaaaaugcacaaacacaucuuugcugccaucuuuaggcguaaugaa

SEQ ID NO: 4245825 - RNA, 58 nt, Salmonella enterica enterica serovar Typhi
gcuggcggacaaaggguuaguugaagaaucgcugggcuacaacgccauugccgccggc

SEQ ID NO: 4245826 - RNA, 92 nt, Salmonella enterica enterica serovar Typhi
ggcgcaggcauggacagcggacgauuuuggucgcggcgaaagcaaagucguugucgccgcgccagugauugccgagcugaauaugccgcguu

SEQ ID NO: 4245827 - RNA, 62 nt, Salmonella enterica enterica serovar Typhi
guaaaauauuaagcccugcgucauccgguccgguuuuggucgagaggguuucaauauuacgc

SEQ ID NO: 4245828 - RNA, 64 nt, Salmonella enterica enterica serovar Typhi
gauauuuuuggccguuaacguaggcuccuucaagucccggagccugcauaaucgcaaagguauc

SEQ ID NO: 4245829 - RNA, 82 nt, Salmonella enterica enterica serovar Typhi
cuuggugauaaacgcgaagguaaaauuaucguuauugaugggucguuaacgcaggaucaguugccuucgcugauugcacagg

SEQ ID NO: 4245830 - RNA, 61 nt, Salmonella enterica enterica serovar Typhi
agcgacagggucuguugugaaguuuauggggauuuucugccucacacagauuccugucgcu

SEQ ID NO: 4245831 - RNA, 63 nt, Salmonella enterica enterica serovar Typhi
guagucauggcggcguggcgcugcggcguuuugaacccgcccagcccaccaccaaugaaaaac

SEQ ID NO: 4245832 - RNA, 62 nt, Salmonella enterica enterica serovar Typhi
guuaauuuuugugggauggcggcuucgcuuuauccgcaggucgccauccggcaaaauguaau

SEQ ID NO: 4245833 - RNA, 55 nt, Salmonella enterica enterica serovar Typhi
guagaacguggugaugugauuuccgaugguccggaagcgccgcacgacauucugc

SEQ ID NO: 4245834 - RNA, 55 nt, Salmonella enterica enterica serovar Typhi
cgcccguagcgaucagcuucuggcgauggucggccccgggcugaugcugugggcg

SEQ ID NO: 4245835 - RNA, 79 nt, Salmonella enterica enterica serovar Typhi
gcgauaccgauuuugguguaugugcgcacugcuauggucgugaccuggcgcguggccacaucaucaacaaaggugaagc

SEQ ID NO: 4245836 - RNA, 127 nt, Salmonella enterica enterica serovar Typhi
uguaaccgcuaccaccuguaaccaauacucucauaauucgcuccguuaagccuaugguauggaauaaccauagcauaacaaagaugcgaaaagugugacauguaauaaauuaguggaaucguuuaca

SEQ ID NO: 4245837 - RNA, 78 nt, Salmonella enterica enterica serovar Typhi
caguguauaaggcgcgaugcuggcgaaggucugcucuuuaucccacgggcagccguuuuccgggucgcgcaggcgcug

SEQ ID NO: 4245838 - RNA, 55 nt, Salmonella enterica enterica serovar Typhi
cgccgugauuacggcgguagguaugguaaaccaucugccgguuaugauggcggcg

SEQ ID NO: 4245839 - RNA, 65 nt, Salmonella enterica enterica serovar Typhi
caggcgucaacagguucgguuguacaguccguaaccggacaguguaaguaaaccugcuacgcuug

SEQ ID NO: 4245840 - RNA, 64 nt, Salmonella enterica enterica serovar Typhi
gcgcgcgccugccggaaaacauuacgccggaauucgugcgugaugaagucgccgcgggccgcgc

SEQ ID NO: 4245841 - RNA, 57 nt, Salmonella enterica enterica serovar Typhi
gcuauuucuggugguucaguauugccggaaggaaaguuauuaaccgccgugaauagc

SEQ ID NO: 4245842 - RNA, 102 nt, Salmonella enterica enterica serovar Typhi
agcuaaugccggauggcggcgugaacgccuuguccggccuacaggugagauaccguuguaggccggauaagacgcguuagcaucgccauccggcauucugcu

SEQ ID NO: 4245843 - RNA, 60 nt, Salmonella enterica enterica serovar Typhi
guuaauuuugugguaaacgccacgccgcuggaacccguggcguuacgccgcgagcuuggc

SEQ ID NO: 4245844 - RNA, 71 nt, Salmonella enterica enterica serovar Typhi
acggcucuugcaggcgccgcuuauugaucaaccuuuggaguugcgcgauaaagcuauguuggaagugcugu

SEQ ID NO: 4245845 - RNA, 63 nt, Salmonella enterica enterica serovar Typhi
gauaaauugugguuauuuuauaaaguaggcagcggcguacacguguggaaaaccugguuuauc

SEQ ID NO: 4245846 - RNA, 68 nt, Salmonella enterica enterica serovar Typhi; identical to SEQ ID NO: 4228091

SEQ ID NO: 4245847 - RNA, 82 nt, Salmonella enterica enterica serovar Typhi
cuguggcacguuuaccguuugccaucuggccgcuaugcgcuauaucgcugcgcgucagggaagcgaggugauucguuugcag

SEQ ID NO: 4245848 - RNA, 62 nt, Salmonella enterica enterica serovar Typhi
cagcgcgggcguaaaaucgguuggcuuaaugacgcagccaaucugaagucugcgucccguug

SEQ ID NO: 4245849 - RNA, 65 nt, Salmonella enterica enterica serovar Typhi
uuggucgucugcguaagcugaacauggggccagaguucuugucggcguuuaccguaggcgaccag

SEQ ID NO: 4245850 - RNA, 62 nt, Salmonella enterica enterica serovar Typhi
ugcgcccuaugaguuugucgaugccgauaauaaaauuguugguuucgauauugaugucgcca

SEQ ID NO: 4245851 - RNA, 76 nt, Salmonella enterica enterica serovar Typhi
gcauccggagacuauaaauugcaggucggcgauuuagauaaccgcagcagcuugcaguuuaucgauccuaaggggc

SEQ ID NO: 4245852 - RNA, 55 nt, Salmonella enterica enterica serovar Typhi
cucgcugucggcuaccgcguucgcuccccgcgcggcacgcaguuccgccaguggg

SEQ ID NO: 4245853 - RNA, 57 nt, Salmonella enterica enterica serovar Typhi
uggauaaagacaauuucgaauaccacuauccgcgugguuuugacgauugcuuuacca

SEQ ID NO: 4245854 - RNA, 94 nt, Salmonella enterica enterica serovar Typhi
gcaucgcggcguuuuauggcagcauuaugggcauuaaguuuucuauuaagcuuaaugguauccaucaugcgguacauaaugcggaccccgauuc

SEQ ID NO: 4245855 - RNA, 62 nt, Salmonella enterica enterica serovar Typhi
agcccauguugcugaugagcgugcuggauaaucucuauuccaacgcugugcacuauggcgcu

SEQ ID NO: 4245856 - RNA, 88 nt, Salmonella enterica enterica serovar Typhi
gggaucugaaucgccagaugguuuuccuguuuguccuggucaggaaugccgaacaggguaaaggaggccggagcagguugcguuuccc

SEQ ID NO: 4245857 - RNA, 80 nt, Salmonella enterica enterica serovar Typhi
uaccagaccagaaugcaguagucgcugcggaggugauaguaauaccacgcuccugcuccugcuccauccaguccauggua

SEQ ID NO: 4245858 - RNA, 91 nt, Salmonella enterica enterica serovar Typhi
gcccggcgauagcgguaucguccagaaucagcgcuuugcucucgcguaaccaggcgccggagguucugaccauaccgccuucccagcgggu

SEQ ID NO: 4245859 - RNA, 55 nt, Salmonella enterica enterica serovar Typhi
auaaucggcugaccagccugccggcguugccgucaggacugaaggagcugauugu

SEQ ID NO: 4245860 - RNA, 63 nt, Salmonella enterica enterica serovar Typhi
accgaacgggaaagugguuaacagcgcaggacggcccgugauauugaccaucucuuccgcggu

SEQ ID NO: 4245861 - RNA, 77 nt, Salmonella enterica enterica serovar Typhi
uuaucuggaacaggauuuagugaugacaaaggacgaccaucuggucguccuccaugaccacuaccuugaccggguga

SEQ ID NO: 4245862 - RNA, 76 nt, Salmonella enterica enterica serovar Typhi
ggcacgccguggcgagagaccuucgcaacugccgccggcaguugacgguuuuucgccagcgcguaaagcauacgcc

SEQ ID NO: 4245863 - RNA, 59 nt, Salmonella enterica enterica serovar Typhi
gaugcccgauuucagcgccuuucagcuggaagguuguaaaguacuggaauacgcgcguc

SEQ ID NO: 4245864 - RNA, 83 nt, Salmonella enterica enterica serovar Typhi
cgcuaaacgugucgaggaaauuaucgcugaaaauaaaccgcccuuuucuguuuuccgcgacaaauucaucaccaugccuggcg

SEQ ID NO: 4245865 - RNA, 65 nt, Salmonella enterica enterica serovar Typhi
uuuucgguauauauaugggauuuuggugacgguuaucaaaaauuaucgcccuaugaugccgagga

SEQ ID NO: 4245866 - RNA, 85 nt, Salmonella enterica enterica serovar Typhi
gcgucuuucgccaucuugauugcagccagaguuucggucagagaaccgaucugguugaauuugaucaggauggaguuagcgaugc

SEQ ID NO: 4245867 - RNA, 78 nt, Salmonella enterica enterica serovar Typhi
gacaucugggguauggcgucaauuucacccacugugcaggcagcggcgaacggguggaugacaccaugaccuaccguu

SEQ ID NO: 4245868 - RNA, 80 nt, Salmonella enterica enterica serovar Typhi
acaugaugauagagagcaacauuauucacgccgcgcaccugcacaacgugaacaaacugcuguuucucgguucguccugu

SEQ ID NO: 4245869 - RNA, 67 nt, Salmonella enterica enterica serovar Typhi
aacgccugugggugaauccggacugcggucugaaaacucgcgguuggccggaaacccgcgcggcguu

SEQ ID NO: 4245870 - RNA, 59 nt, Salmonella enterica enterica serovar Typhi
gacagcgcuucccugcugguggcguuuauucuuagcguuauuaaggcgauagugcuguu

SEQ ID NO: 4245871 - RNA, 62 nt, Salmonella enterica enterica serovar Typhi
uuauaucgcucuauaaucguuguauaauuauuuauauaucgauuguggggcgaaaccuauga

SEQ ID NO: 4245872 - RNA, 67 nt, Salmonella enterica enterica serovar Typhi
uccagaacagauaacggugggucgcuucauuaaccucuuuaagcgcauccuccaguuggcuguugga

SEQ ID NO: 4245873 - RNA, 74 nt, Salmonella enterica enterica serovar Typhi
gcccagaccaagaucaugaaaaaacuguccggagguauucguaccgcgcuggcgcaguaucgugaacuggcggc

SEQ ID NO: 4245874 - RNA, 64 nt, Salmonella enterica enterica serovar Typhi
ggaacccgaaaggacaaucgauguagcaggucagucuacacaucgagauggauuuuuggguuuc

SEQ ID NO: 4245875 - RNA, 58 nt, Salmonella enterica enterica serovar Typhi
cgcgcuuuaacagcagccgagguguuagcauagaccacuacgguucugucagggugcg

SEQ ID NO: 4245876 - RNA, 60 nt, Salmonella enterica enterica serovar Typhi
ggugaaacgcugaaugucucccugccaucaaugggagaagagagauacacagcguuuacc

SEQ ID NO: 4245877 - RNA, 60 nt, Salmonella enterica enterica serovar Typhi
ccauguucgcgauggugcuggcgaucgggcuccuggucgacgaugccaucgugguggugg

SEQ ID NO: 4245878 - RNA, 69 nt, Salmonella enterica enterica serovar Typhi
gugaauaaucacccggcggcgcgauacaccaccgcugcggucgguaaagcgcaucggguuauuguucac

SEQ ID NO: 4245879 - RNA, 66 nt, Salmonella enterica enterica serovar Typhi
gcgggcugggacuuaaaagcggcagcggaaggugaagcgccggaugccgauuuuggucccggcggc

SEQ ID NO: 4245880 - RNA, 130 nt, Salmonella enterica enterica serovar Typhi
cgcugcaauugucuuuuuaaccauaaugucuuccuuuucuagccaauguuguuuguguauagcaacuuaauaauagacaacaucccagaaaaugacgggcgaucgacuaauuuuaggaagacgagaagcg

SEQ ID NO: 4245881 - RNA, 72 nt, Salmonella enterica enterica serovar Typhi
cugcgacaaaaucaccccagggaugcucauggccucgcugcgccugaauauuccggugaucuuugucuccgg

SEQ ID NO: 4245882 - RNA, 89 nt, Salmonella enterica enterica serovar Typhi
agugauguucugaccgugaauugccggauggcgccguaggccggauaagacgguuacgccgccaucaggcaaaacaacaggagcacauu

SEQ ID NO: 4245883 - RNA, 79 nt, Salmonella enterica enterica serovar Typhi
gcuuucggugcuggcuacggucacgaagucggacggaaucgccgucacuuuaucgccguggcucauccacacguccagc

SEQ ID NO: 4245884 - RNA, 97 nt, Salmonella enterica enterica serovar Typhi
cgucgcuuccugcauuugaugguaugccagugugacccgaucuucacagcuuaucguugcauccaucgcuauaauaaaugcgguuucucuuagugcg

SEQ ID NO: 4245885 - RNA, 56 nt, Salmonella enterica enterica serovar Typhi
agcgguagaagacaaugguugaaggcuccaucaccuccagcacuugcuucauugcu

SEQ ID NO: 4245886 - RNA, 122 nt, Salmonella enterica enterica serovar Typhi
gacgguaaaugguguuucacaguuucagccagaaugggucugcugggagcccgauguggagugggugcgucagccgccgacagaugccauuacugauacgacguauuuuccuuuuuaccguu

SEQ ID NO: 4245887 - RNA, 70 nt, Salmonella enterica enterica serovar Typhi
ggcccuuaugaggugguggaaaacaauggcuuucaucugcaaaugaaggccuuugaccacuauuucggcc

SEQ ID NO: 4245888 - RNA, 77 nt, Salmonella enterica enterica serovar Typhi
ggaaaguacuggcguagcgugauuacgaccggcgagccggagagcgcuuaccgguaugacgcgcuaaaccgcuaucc

SEQ ID NO: 4245889 - RNA, 69 nt, Salmonella enterica enterica serovar Typhi
ccauccguugugugggauaccgccagauguggucauacauugagggcgaaaucucauaugaugaaaugg

SEQ ID NO: 4245890 - RNA, 77 nt, Salmonella enterica enterica serovar Typhi
cgccugccgccauugccugacggucgccauaaauuuucgccacgcgagacugcauuucaauggcuuccggcacggug

SEQ ID NO: 4245891 - RNA, 89 nt, Salmonella enterica enterica serovar Typhi
auucgcuggcgcucaaugucggcagaaaagucgagcugcgggccguccugcgccucaaccgcuuucgccugcgcuuccgccaguugaau

SEQ ID NO: 4245892 - RNA, 86 nt, Salmonella enterica enterica serovar Typhi
ucuuuaagaauagaugacgacgccagguuuuccaguuugugacgaaggugauugaaaaaaccuggcguauugucugucaucagaga

SEQ ID NO: 4245893 - RNA, 59 nt, Salmonella enterica enterica serovar Typhi
cgguaguuuuguugccggauggcggcgugaacgccuuauccggccuacagaacugcacg

SEQ ID NO: 4245894 - RNA, 61 nt, Salmonella enterica enterica serovar Typhi
cugcguaauggacuauggcgccggauaaacugccugauggcagcccuacguccgcacgcgg

SEQ ID NO: 4245895 - RNA, 93 nt, Salmonella enterica enterica serovar Typhi
gcagcuucugggaagggguggacgugcgcggcgauacguuaucuuuggugauuaucgacaaauugccguuuacuuccccggacgacccgcugu

SEQ ID NO: 4245896 - RNA, 92 nt, Salmonella enterica enterica serovar Typhi
cggcgcagcgguagcgcagaauaagguucaacguauugaugauguucaugcguuugacggccauauugccugugaugccgccagcaacgccg

SEQ ID NO: 4245897 - RNA, 91 nt, Salmonella enterica enterica serovar Typhi
caugcuggaacugcugcuggcaggcgggauggacauuauccgcgccaugcgccuguuggugccgcccgccuggcagaacaaccccgauaug

SEQ ID NO: 4245898 - RNA, 57 nt, Salmonella enterica enterica serovar Typhi
gaugggcuguuuaaggaaaccuucgcuggccgcgaccucguccuggaacgccgcauc

SEQ ID NO: 4245899 - RNA, 92 nt, Salmonella enterica enterica serovar Typhi
uguuugacaggcagucaauauuuauucauggaaugaaaaucaguuugcagcagcacauuccaggaauaaguauccagagugucggucaggca

SEQ ID NO: 4245900 - RNA, 77 nt, Salmonella enterica enterica serovar Typhi
uuugaugcugccuguaacgacgcgccacaucggugguuauuccgguguaaagcgcauugucugcaguacgaaucaga

SEQ ID NO: 4245901 - RNA, 81 nt, Salmonella enterica enterica serovar Typhi
acaugcuaugccggugguaaaacccgaccagauacgcacgccguggcgggaguucuggcgucguuuucgccgccagcaugu

SEQ ID NO: 4245902 - RNA, 86 nt, Salmonella enterica enterica serovar Typhi
gcguauucguggggcgaugcuggaugaauuacgcagccgcgauugggugccgcguagcguccggcguaaugcccgcgaaguggcgc

SEQ ID NO: 4245903 - RNA, 68 nt, Salmonella enterica enterica serovar Typhi
aguuugguauccaacuguuuauccgucauguugcguuuccugauuuuaaccgucuggaugucuaaacu

SEQ ID NO: 4245904 - RNA, 57 nt, Salmonella enterica enterica serovar Typhi
gagcguuuuuaacguugggguuguagacaaacucccggacggcaggaaagaacgcuu

SEQ ID NO: 4245905 - RNA, 64 nt, Salmonella enterica enterica serovar Typhi
caggcaucagacaagugaagaagcccauccugacggacgggcuuuuuugcgugugugguaacug

SEQ ID NO: 4245906 - RNA, 63 nt, Salmonella enterica enterica serovar Typhi
auugacgauaucggcauugacgcgcuggacaaagucuuccagguucaggucgaugucaucaau

SEQ ID NO: 4245907 - RNA, 62 nt, Salmonella enterica enterica serovar Typhi
ugccgucguaccuaaugcuucgccuuaucaucguaaugaagugucuuuagauacgacaggca

SEQ ID NO: 4245908 - RNA, 60 nt, Salmonella enterica enterica serovar Typhi
gaucugguucccgcugugcagcaggccguugcgcaacaguacgaagcgaaaaccggaauc

SEQ ID NO: 4245909 - RNA, 55 nt, Salmonella enterica enterica serovar Typhi
uuuacggaucugcaggaucaggucauugcgaaccuguucaagcucuauccguggg

SEQ ID NO: 4245910 - RNA, 80 nt, Salmonella enterica enterica serovar Typhi
caguaucgccauuacgcuggcggaugcguuagggauggcccccggucgcuggaaaguauucgccagcgauauugauacug

SEQ ID NO: 4245911 - RNA, 65 nt, Salmonella enterica enterica serovar Typhi
ugaagaucagcagcgauuugaugcauuagcaaaacaguacgcuacgcagauuguuguuuaucuca

SEQ ID NO: 4245912 - RNA, 65 nt, Salmonella enterica enterica serovar Typhi
gcgcaaaucagucauagcggcuuucagugucaucagaccaucacccagcgcuguacugauugcgu

SEQ ID NO: 4245913 - RNA, 65 nt, Salmonella enterica enterica serovar Typhi
ugauguguucugggaucugcaggacccggcaaccgaugcgggacugcugaaccagaacgacguca

SEQ ID NO: 4245914 - RNA, 65 nt, Salmonella enterica enterica serovar Typhi
uuacgccaucucuucuggcggccucaugcggugaaugccgcggucgucugaaggaugaagcguaa

SEQ ID NO: 4245915 - RNA, 72 nt, Salmonella enterica enterica serovar Typhi
guaggccggauaaggcggagccgccauccggcggugcagguugccugauggcgcugcgcuuaucaggccuac

SEQ ID NO: 4245916 - RNA, 84 nt, Salmonella enterica enterica serovar Typhi
agcgcagcuccagcauuacgccgcgaccacgccgaucguugauauggugcguuucucuccggcgcagcuggaugcucaggcgcu

SEQ ID NO: 4245917 - RNA, 60 nt, Salmonella enterica enterica serovar Typhi
gccaugcgccgagaucggcgaagauuuugcgcgucaguucuacgcuuuuuucgcgcaggc

SEQ ID NO: 4245918 - RNA, 56 nt, Salmonella enterica enterica serovar Typhi
uauggcgccuguucgauaaaucagauggccacgcuggaugaucucaaggcgcugua

SEQ ID NO: 4245919 - RNA, 102 nt, Salmonella enterica enterica serovar Typhi
gucgucaguggugguaaugcgcgcuauuacgauauucaggaguugcugaucggcaaaucuccugaaaccguugaugcggcgaauauuaauauuacuuacgac

SEQ ID NO: 4245920 - RNA, 73 nt, Salmonella enterica enterica serovar Typhi
uggauaagccgguuuuugcugauguggucgaugaguuucucgauuauauccgcggcgcggagcuggucaucca

SEQ ID NO: 4245921 - RNA, 122 nt, Salmonella enterica enterica serovar Typhi
cgcugccaccuucuaaaacugcgaaugguuuugcguuucguuuuuuuauggaggccuuaaacacccggcucuugaugcagacgacgacaugcgcugccauccucgcggaacagaugacagcg

SEQ ID NO: 4245922 - RNA, 69 nt, Salmonella enterica enterica serovar Typhi
gauauccagaugagcuucccgcuauuugcgcugcuugcccgaggcggaaucgcucaucucgaccauauc

SEQ ID NO: 4245923 - RNA, 55 nt, Salmonella enterica enterica serovar Typhi
ucugcaaacguaggaaaaggguuguacuuguuuacccuuuucgaacgccugcgga

SEQ ID NO: 4245924 - RNA, 58 nt, Salmonella enterica enterica serovar Typhi
ggcgauaugugugauagcuaucgguuugaugacgcgauauaucgaucccguauucgcc

SEQ ID NO: 4245925 - RNA, 63 nt, Salmonella enterica enterica serovar Typhi
ggaaucaacgcgaccaggcgcggcagaagugagcguggaagaagagcuggaucgcguuauucc

SEQ ID NO: 4245926 - RNA, 79 nt, Salmonella enterica enterica serovar Typhi
ggucuuguucaacagucgguagcugaucaaauauuucuaagagccgcuuuugucggucauugagaucuguuggaccacc

SEQ ID NO: 4245927 - RNA, 129 nt, Salmonella enterica enterica serovar Typhi
aucuuuggaaucuacauagccgaugauguggucgauaucuucauuacacaccaaaaauuuugagugcggauguucggcuaccuuuuucuucaggcuuuguucgucuucguguagaucaaaccagaugau

SEQ ID NO: 4245928 - RNA, 66 nt, Salmonella enterica enterica serovar Typhi
agccauaauuuguauacuaugagcugauuuucuauuuuaaaucagcaagcgcugugcaaguuggcu

SEQ ID NO: 4245929 - RNA, 72 nt, Salmonella enterica enterica serovar Typhi
gcaauguugcaaccagagcccuuaaauauguacgccagaagaaaacugaagggcgucuggaugaagcauugu

SEQ ID NO: 4245930 - RNA, 81 nt, Salmonella enterica enterica serovar Typhi
augucugauggcgcugcgcuuaucaggccuaccagccgagugcuuauguaggccugauaagguaaagccgccauccggcau

SEQ ID NO: 4245931 - RNA, 68 nt, Salmonella enterica enterica serovar Typhi
uaaaaugccugcuguucauacauuaaaugauaaaccuguuuuauugauuguuuacgcgggacauuuua

SEQ ID NO: 4245932 - RNA, 56 nt, Salmonella enterica enterica serovar Typhi
ggcguguuguucccgucauucgcauugauugucgcggauguauuugacugcgcgcu

SEQ ID NO: 4245933 - RNA, 59 nt, Salmonella enterica enterica serovar Typhi
gccggucuauaaaauugcgcuggguauugaguacgacggcagcaaguauuauggcuggc

SEQ ID NO: 4245934 - RNA, 66 nt, Salmonella enterica enterica serovar Typhi
cauauucagauagauauucgcauccggauggcaguuagcuucggcguaguacuuauccugaauaug

SEQ ID NO: 4245935 - RNA, 82 nt, Salmonella enterica enterica serovar Typhi
aggugacgauagacgguacguugacuacgccggugauugagcuggcggccggcgaagauagcgguacuguuggcgaucgccu

SEQ ID NO: 4245936 - RNA, 63 nt, Salmonella enterica enterica serovar Typhi
gaaauuggccucagauuaauguuaagcgucuugccggacgcguaauguuaacuggggcuuuuc

SEQ ID NO: 4245937 - RNA, 82 nt, Salmonella enterica enterica serovar Typhi
uucaccucuugaauauucuuucuaacagguauacuguguuuauauacaguaguuaaauguagagggaauuaugagaauugaa

SEQ ID NO: 4245938 - RNA, 83 nt, Salmonella enterica enterica serovar Typhi
cucagcaaauuacuggcauuuaucgauggcgcaggauuaguggacacgacauaugcugaauccgauaaauggguuuugcugag

SEQ ID NO: 4245939 - RNA, 70 nt, Salmonella enterica enterica serovar Typhi
gcuggaagccuggugcgccgagcaagauuccgggcugaggcucaaucuucauccgcgcgcccaugccagc

SEQ ID NO: 4245940 - RNA, 72 nt, Salmonella enterica enterica serovar Typhi
uagaugacagauuaugcgucauucgcuaaaguuuccggucaauuuggaugaacuuuguaugaucucuauuua

SEQ ID NO: 4245941 - RNA, 55 nt, Salmonella enterica enterica serovar Typhi
uugaugcuggucuacggcugcgcgcuuuacggcgccuggcuggcacccgcaucaa

SEQ ID NO: 4245942 - RNA, 69 nt, Salmonella enterica enterica serovar Typhi
ggcuccugaugcuguugcaugaugguguaaauuuuaucaauaucaauauguugccgcaucgcuuccgcc

SEQ ID NO: 4245943 - RNA, 67 nt, Salmonella enterica enterica serovar Typhi
uccggcaagccccguacgcagguucugcgcuggcagcgccagaacuggguagcggggcuucgcuggg

SEQ ID NO: 4245944 - RNA, 62 nt, Salmonella enterica enterica serovar Typhi
auugauagcggaaaauugggcuauagcauuaccguugcugagccugauuuuaccgcugcggu

SEQ ID NO: 4245945 - RNA, 74 nt, Salmonella enterica enterica serovar Typhi
gcgagcgugcaggucaaagaggauuuuaaaaauaaucgaacguuguuaaucacuuuggcgcugauaagcaucgc

SEQ ID NO: 4245946 - RNA, 64 nt, Salmonella enterica enterica serovar Typhi
cgauauucguagccuggcacuggcggaacacuacuucggcgccagucaggauugcgaggacucg

SEQ ID NO: 4245947 - RNA, 72 nt, Salmonella enterica enterica serovar Typhi
uggucaguaugguaagcagcuaucuuuaaauuucuuuacaacaagcguaaagauaagcugcuuuacucccca

SEQ ID NO: 4245948 - RNA, 56 nt, Salmonella enterica enterica serovar Typhi
gcgauugauaucuggaacgugaccaaugggaaacguuucucaaccuaugcgauugc

SEQ ID NO: 4245949 - RNA, 76 nt, Salmonella enterica enterica serovar Typhi
cguagguuucgucgaagaugacggcuucgccgucgcgccagcuauggcgcugucgaucaacuucaauaaaacagcg

SEQ ID NO: 4245950 - RNA, 65 nt, Salmonella enterica enterica serovar Typhi
gccagcgguagaaaagccagugauagcuucacccauucgauacgaucgccgguuucugccgcggu

SEQ ID NO: 4245951 - RNA, 66 nt, Salmonella enterica enterica serovar Typhi
gccgggauucugccgaaacugaucggcgguuacuucgauaccgaucagcgcgcggcggggcugggc

SEQ ID NO: 4245952 - RNA, 71 nt, Salmonella enterica enterica serovar Typhi
ggcaggcgugaaugugucugcgugauggucaacugaacguucagcgcugcggauauauucacgaaccuguu

SEQ ID NO: 4245953 - RNA, 64 nt, Salmonella enterica enterica serovar Typhi
gauuaucugaaaaauccggccuuuugggaaaaaaugaacaacggcugggaugaguucaguauuc

SEQ ID NO: 4245954 - RNA, 83 nt, Salmonella enterica enterica serovar Typhi
auugcgaccagaucaugaugaucacggaugccgguacucuggugcguacccgagugucugagaucagcguggugggacguaau

SEQ ID NO: 4245955 - RNA, 71 nt, Salmonella enterica enterica serovar Typhi
gccacggcgcgcaaugaagcaggcauacuaccaaaauggaucuaucuggcaauuuauugcguugcaucggc

SEQ ID NO: 4245956 - RNA, 58 nt, Salmonella enterica enterica serovar Typhi
gccgcgaaaugacucgauauucagauugagcggcaggugaacaucggucaucuccggc

SEQ ID NO: 4245957 - RNA, 55 nt, Salmonella enterica enterica serovar Typhi
gggaaacuggugcgacggcguaacguaaaccagcggcgcaggcggcaguuuaucc

SEQ ID NO: 4245958 - RNA, 75 nt, Salmonella enterica enterica serovar Typhi
ggcgugcugacgcgugacggcgacuauuuuauuucggugauggggcggucugauguggcgcguaagcaaaacgcc

SEQ ID NO: 4245959 - RNA, 74 nt, Salmonella enterica enterica serovar Typhi
ccucggcccggaugaagucguuaauaaguacggugugccgccugagcugauuauugacuuucuggcgcugaugg

SEQ ID NO: 4245960 - RNA, 76 nt, Salmonella enterica enterica serovar Typhi
gcccgguggcgcugcgcuuaccgggccuacacguugcgacaaccuguaggccggauaagcauuagcgccauccggc

SEQ ID NO: 4245961 - RNA, 62 nt, Salmonella enterica enterica serovar Typhi
gauagucauagaauuccucuuuuuaaucacuauguucguuaacugaggggauuaugaccuuc

SEQ ID NO: 4245962 - RNA, 73 nt, Salmonella enterica enterica serovar Typhi
gcgccgccggggacgguggcaauauugagcguggauucaccgcuuagcguuacgcuacugucuccgcugaugu

SEQ ID NO: 4245963 - RNA, 60 nt, Salmonella enterica enterica serovar Typhi
auagguggcguaaaauccgaacaagaaaaaaucaaacuguucaaggaaauugccgcuugu

SEQ ID NO: 4245964 - RNA, 65 nt, Salmonella enterica enterica serovar Typhi
uacacguugucguaugagcgaucgcugcgggggacuggaggcaucgaaguccgaucaacccugua

SEQ ID NO: 4245965 - RNA, 85 nt, Salmonella enterica enterica serovar Typhi
uuaucgccgaagagcgcuacguuuaccuggccuacagaugacguguauuuguaggcccgguuagcguuacgcuaccgggcgauaa

SEQ ID NO: 4245966 - RNA, 129 nt, Salmonella enterica enterica serovar Typhi
uuaucacgauuauuucgcaacugcccgaugcagaauaucuggugauaagcggcagccugccacaagguauugaaagucgcuuuuacgcagaaauuaugcauauuugucagcaaaaaaauaucggcguaa

SEQ ID NO: 4245967 - RNA, 66 nt, Salmonella enterica enterica serovar Typhi
ugucugcaucucuugaggcuauguuugccgaugagggcguaaacaagcugauuaaggauuuggaua

SEQ ID NO: 4245968 - RNA, 58 nt, Salmonella enterica enterica serovar Typhi
ugugaccauuaucgggcaaucauugauuccgcagauggauugccgauggugguauaca

SEQ ID NO: 4245969 - RNA, 108 nt, Salmonella enterica enterica serovar Typhi
ucaguuccaguuucagcuuuucaagcaacggacaacgagaaucuaugcugaucagcucauccacaagauacuguucuccguuguuaauagcguuaaacguauuucuga

SEQ ID NO: 4245970 - RNA, 57 nt, Salmonella enterica enterica serovar Typhi
gccgcgcugaacauguugcugacgccgcauggcgcgcaauuuacucucagucgcggc

SEQ ID NO: 4245971 - RNA, 115 nt, Salmonella enterica enterica serovar Typhi
gguaauacugugccggauggcggcugcgccuuauccggccuacaagauuugcaauaucaguauauugcgauaaauucuuguaggccuaauaaacgcagcgccaucgggcauuacc

SEQ ID NO: 4245972 - RNA, 55 nt, Salmonella enterica enterica serovar Typhi
cuaugcauaaaagcagcggcuaaugccauucggcauuagccguuuuuuugcaugg

SEQ ID NO: 4245973 - RNA, 103 nt, Salmonella enterica enterica serovar Typhi
accggcgucauggcaggcaccuggcugcugacgguccuguuaagcgguuauucaucguuaggggcgauugucagcgccuugauugcgccguuuuacgucuggu

SEQ ID NO: 4245974 - RNA, 55 nt, Salmonella enterica enterica serovar Typhi
uauggcuucccaacggauguugucacuuuugauaacuucaccauggaagauuaua

SEQ ID NO: 4245975 - RNA, 68 nt, Salmonella enterica enterica serovar Typhi
agccuugaugcgcuguguucgcguuaugagauagauaauagcaaacguacuuugcacggcgcauugcu

SEQ ID NO: 4245976 - RNA, 55 nt, Salmonella enterica enterica serovar Typhi
gggcuuaugcacuaaauaagaauuuagcgcuugcuaauauuuagggcguaagucc

SEQ ID NO: 4245977 - RNA, 58 nt, Salmonella enterica enterica serovar Typhi
aagguaccgucgguggcuggcgucauacaggacaucaccaggcgaccacgcguaucuu

SEQ ID NO: 4245978 - RNA, 85 nt, Salmonella enterica enterica serovar Typhi
cggcggaacgcagcgacuucagugccaguacuguaagaaggucuggacgccaaaacagcacgcgcugaaugucgccgaaacgccg

SEQ ID NO: 4245979 - RNA, 81 nt, Salmonella enterica enterica serovar Typhi
gcaggagcagaacagguuacggucgccauaaacaucauccagacguuucaccgucggccaguauuugucugccacgccugc

SEQ ID NO: 4245980 - RNA, 56 nt, Salmonella enterica enterica serovar Typhi
uuuaaucagacacgugucggcgucggcgugaugcuuaacgauaucuucugauugga

SEQ ID NO: 4245981 - RNA, 76 nt, Salmonella enterica enterica serovar Typhi
gauuaacgacucgucuaucaccggcauuaaaacgggccugauggggccgcuugccgggaugggcgacucgauuauc

SEQ ID NO: 4245982 - RNA, 87 nt, Salmonella enterica enterica serovar Typhi
ucauuuuuauucuucgcgucaugcguuauaucagccggggaugggggcuucagugauauaucaugauagcgaguuauuuaaggauga

SEQ ID NO: 4245983 - RNA, 65 nt, Salmonella enterica enterica serovar Typhi
ccguccggcgucauggggcgcaggccgguccagaauguggccugcucaauaugaccgccgcgcgg

SEQ ID NO: 4245984 - RNA, 66 nt, Salmonella enterica enterica serovar Typhi
gggcgagaugaugaaguuuaccgguaucccgaacuuugcgccggaacuguuccgucguauucgccu

SEQ ID NO: 4245985 - RNA, 59 nt, Salmonella enterica enterica serovar Typhi
agcggguuuuaccauuaccgauguaaacccugauuuugucaucguuggagagacccgcu

SEQ ID NO: 4245986 - RNA, 68 nt, Salmonella enterica enterica serovar Typhi
guugccccaggguuugacguuuccacuucgccagugaaugcaccacuucgaacugggcgucaggcaac

SEQ ID NO: 4245987 - RNA, 57 nt, Salmonella enterica enterica serovar Typhi
acgaauggccgcccguuuuauucccguaaugagcuuauagaacaauuggucauucgu

SEQ ID NO: 4245988 - RNA, 69 nt, Salmonella enterica enterica serovar Typhi
cacgcaucgcgucagcgcgugaggcaguuaauguuccgacauuaaucagcaaggcguuggcgauggcgg

SEQ ID NO: 4245989 - RNA, 73 nt, Salmonella enterica enterica serovar Typhi
uuuugucagcaucuucaaaacgcugcaugagcugaacuaucgcgguucauuucugauugagauguggacagag

SEQ ID NO: 4245990 - RNA, 78 nt, Salmonella enterica enterica serovar Typhi
ggcgguggcggcggcggaacaucggcauuaauggugaaaaugaccguauaguugccgccguuuugccgcuucaccgcc

SEQ ID NO: 4245991 - RNA, 65 nt, Salmonella enterica enterica serovar Typhi
gcagguugauagggcgaucgccgguuuugguaucuucugacggguaguaucgcucuauauccugc

SEQ ID NO: 4245992 - RNA, 77 nt, Salmonella enterica enterica serovar Typhi
gcggcgcugucgguugcugcggcugcugguacugcggcugaggcgcuaccggcuguugcggcugcugauacuguggc

SEQ ID NO: 4245993 - RNA, 67 nt, Salmonella enterica enterica serovar Typhi
cgcgaugauggcauccagaucgggauacgcuuugaugauaccuuccgccgucuggagcgauuucgug

SEQ ID NO: 4245994 - RNA, 80 nt, Salmonella enterica enterica serovar Typhi
gcgcuaccacuuccggcccugcaugccagauaaccuucccgcucucuuuauccacggcaaugacgccggaagugguacgc

SEQ ID NO: 4245995 - RNA, 95 nt, Salmonella enterica enterica serovar Typhi
gaccgcccaucuuaaagauguucuguucgugauggcaggccaaaauuaccgagccggaugccaggaacagcagcgcuuuaaagaaggcgugcguc

SEQ ID NO: 4245996 - RNA, 62 nt, Salmonella enterica enterica serovar Typhi
gguccuaucguucguccuggauuaucggcgaagcggucgaugcuaucccggaugauaugacc

SEQ ID NO: 4245997 - RNA, 76 nt, Salmonella enterica enterica serovar Typhi
uuuuuucagaugcggcuucagguuaauuuccgcucggaagagagugagauuccugaugcugaaccguuugaauuag

SEQ ID NO: 4245998 - RNA, 68 nt, Salmonella enterica enterica serovar Typhi
gagcacauugcuaucaaagaagcgaacaaccuggguaucccgguauuugcuaucguugauaccaacuc

SEQ ID NO: 4245999 - RNA, 128 nt, Salmonella enterica enterica serovar Typhi
agagccuaucccauuaggcuauuuuauucgccauuuuagggccgggcagugcucgaaauccucacgguuucugcgcgcuguccggccccaaacuggcuucaacaauuacgccuacugggauaggcucu

SEQ ID NO: 4246000 - RNA, 129 nt, Salmonella enterica enterica serovar Typhi
uauuugcuuucuguauguaugggaugcauacgcaucaggcgcugacgaacuuuuccgauuuuguuaucgcuguaucguucagcuucuaugcuaaugcgcgcuucaccuuuaaugccagcacuacugcaa

SEQ ID NO: 4246001 - RNA, 71 nt, Salmonella enterica enterica serovar Typhi
ggaaaucaguuuuauggcugggccgauugauguuugcaaacccuauacuggcugucauagggcugaucgcc

SEQ ID NO: 4246002 - RNA, 69 nt, Salmonella enterica enterica serovar Typhi
uuucgguugaaaccuuacagcgccugcgcgaugccaaaccgcagggugguauuggguuauuaaccguga

SEQ ID NO: 4246003 - RNA, 77 nt, Salmonella enterica enterica serovar Typhi
ggcgcagggcguggaugccccgcugaauaucaucgccugcgaaaauauggugcgcggcaccacgcagcugaaaggcc

SEQ ID NO: 4246004 - RNA, 108 nt, Salmonella enterica enterica serovar Typhi
uuugccugguguggguucgauuccugcuacugucugauaauuguuggguuaguuucuucuugauaggguaucagcagggcaggcuuucgaaauuugacauccagcaag

SEQ ID NO: 4246005 - RNA, 63 nt, Salmonella enterica enterica serovar Typhi
gacuuuacuugauuccaacauauuggacuccagucugagacacuggaaucagugugaaagguc

SEQ ID NO: 4246006 - RNA, 80 nt, Salmonella enterica enterica serovar Typhi
cguccaugcgcuguacaaugucgcgauugugcaacagaaaaccaucggcaauaucguguaaaucguccagcgccuguucg

SEQ ID NO: 4246007 - RNA, 68 nt, Salmonella enterica enterica serovar Typhi
gaguagauggcgggcagcacaaaagcgguuuccagauugccgcccaugcucagcaccaccaccugcuc

SEQ ID NO: 4246008 - RNA, 93 nt, Salmonella enterica enterica serovar Typhi
gcucugauuugccggauggcgcugcgcuuuccggccuacaaauccaggccuguaggccggauaaggcguuagccgccauccggcgauguaagc

SEQ ID NO: 4246009 - RNA, 79 nt, Salmonella enterica enterica serovar Typhi
gcgcuaucgccgcgcagugaggacauauuuguucuacguugccacguuuuacaaaaugaucuuuauugagcuugagcgc

SEQ ID NO: 4246010 - RNA, 75 nt, Salmonella enterica enterica serovar Typhi
gcucauguucguuuccuguuaaugaaauacuggcgcggcugcccgcgccguuaagguuaaucagaggccgagggc

SEQ ID NO: 4246011 - RNA, 59 nt, Salmonella enterica enterica serovar Typhi
ccuuaugcagaucgccauuggcgcgcuguuggcguggccgacguuugguuugcaugugg

SEQ ID NO: 4246012 - RNA, 65 nt, Salmonella enterica enterica serovar Typhi
ugauaacggacucuucuuccgaaucgcgauuguaauuguaauucgcaaugagaguuugguaguua

SEQ ID NO: 4246013 - RNA, 60 nt, Salmonella enterica enterica serovar Typhi
gucuuuaaccugaguaacacgguuugcuucaacuucgauuacgguuacugggauagagac

SEQ ID NO: 4246014 - RNA, 118 nt, Salmonella enterica enterica serovar Typhi
gcgccggugguaucugcguccaguuccagcucgcgaugucguuauaccgcugggccgcgccgugaauggcgcgcucuacgguauagccgucauuguugagcagcaggaugaccggcgc

SEQ ID NO: 4246015 - RNA, 73 nt, Salmonella enterica enterica serovar Typhi
gguucugacggaaacgacccugcuuaccuuugaucaugucggccaaagauuucagaggacguuuguuagaacc

SEQ ID NO: 4246016 - RNA, 79 nt, Salmonella enterica enterica serovar Typhi
gucacacugucuauacuuacaugacuaaugagaccguuugugagucucaauaugaugauaaggaggagaccaggguggc

SEQ ID NO: 4246017 - RNA, 82 nt, Salmonella enterica enterica serovar Typhi
uuuguuuucggugcucguugugguccaucugaucuauuuuucgcaaaucagcagcaugacgcgcgacgcgcuggcagauaaa

SEQ ID NO: 4246018 - RNA, 74 nt, Salmonella enterica enterica serovar Typhi
cgcuaagaaaacucacgugcuggcggugaacggugaaauuuauaaccaucagacguuacgcgcggaguauggcg

SEQ ID NO: 4246019 - RNA, 64 nt, Salmonella enterica enterica serovar Typhi
auggcagggacgcccggugugucagcgagucacucaccgacagcgcaucagggcuccgguccgu

SEQ ID NO: 4246020 - RNA, 61 nt, Salmonella enterica enterica serovar Typhi
guuacugucggcgauauagcgcugaaguccgcgauuuagcguuggcgucaucgacauuaac

SEQ ID NO: 4246021 - RNA, 61 nt, Salmonella enterica enterica serovar Typhi
ucucguuggugguucuuagcauucugacuaugauucaucugaauguggagcaacuauggga

SEQ ID NO: 4246022 - RNA, 74 nt, Salmonella enterica enterica serovar Typhi
ccguaaauacggcguugacgagucgcugauucuggcgauuaugcaaacggaguccucguuuaacccguaugcgg

SEQ ID NO: 4246023 - RNA, 83 nt, Salmonella enterica enterica serovar Typhi
gccaguuuuugccaggccugcggcgcguuaucgccauaaacuuugcgcauccacaguaacagccccagcccuggcguacuggu

SEQ ID NO: 4246024 - RNA, 95 nt, Salmonella enterica enterica serovar Typhi
gcucaacacauaucaccaaucugguguucuccauuuugcgcaacgcccgggcgcugcacgucggcgaagcgccaaacauggugguaugcuggggc

SEQ ID NO: 4246025 - RNA, 86 nt, Salmonella enterica enterica serovar Typhi
gguuaucauuccugauuuuuccagaugauucagacaggguuccuauacuuaggcuguguaugauucauccggagaggaauaugacc

SEQ ID NO: 4246026 - RNA, 116 nt, Salmonella enterica enterica serovar Typhi
aguggaagucacucgcuaacgacguugugcccggauggcguguagcgauccgggccugaauuucaggcuggauaagugaaacgccauccggcguugugcaguaacaggcuaccacu

SEQ ID NO: 4246027 - RNA, 99 nt, Salmonella enterica enterica serovar Typhi
cgguaaaccgcguugggacuggcagccggaagccgucaacgacgcguugaacgcgcguguugcugcgcuggcugaaucucgucugagcgacgcguaccg

SEQ ID NO: 4246028 - RNA, 75 nt, Salmonella enterica enterica serovar Typhi
caugaccgagcagguuuuugacgcaaagaagguuuugguauuuuuaugcgccgcaaaugccugcuggauuucaug

SEQ ID NO: 4246029 - RNA, 66 nt, Salmonella enterica enterica serovar Typhi
uuuucacuguugaagauaaacucuuucgcuuuuuccagcgucgaagcgguuccacaacaaugaaaa

SEQ ID NO: 4246030 - RNA, 58 nt, Salmonella enterica enterica serovar Typhi
gcgauccuguucagggaacucaugcuaucgccacggcaguuacccucaacaagggcgc

SEQ ID NO: 4246031 - RNA, 66 nt, Salmonella enterica enterica serovar Typhi
ugacggcguugaaguucgucauaucgugggcgcuaucgcuaacgaaggcgacauuagcagccguua

SEQ ID NO: 4246032 - RNA, 86 nt, Salmonella enterica enterica serovar Typhi
ugacguugugaacuucggaagcagugaugacaccgaggcguagacggugccacgcgucaucaccuugcucgauguugcuaacguca

SEQ ID NO: 4246033 - RNA, 67 nt, Salmonella enterica enterica serovar Typhi
gguuaucgcuggucaguuugcuguacacgcgaucgucgguauagccgaaguugaccgcuuuauaacc

SEQ ID NO: 4246034 - RNA, 61 nt, Salmonella enterica enterica serovar Typhi
ggugccgggcuuugaugaguggcuauggguacuggcuuauccgggcauuaaaguuuccacc

SEQ ID NO: 4246035 - RNA, 93 nt, Salmonella enterica enterica serovar Typhi
ccaccucuggcaacgccgucgcgacgccagcggcaaucgcgcugcucgauccgcauuuuaccgaccuggcgucgacggcggcggcgcaggugg

SEQ ID NO: 4246036 - RNA, 86 nt, Salmonella enterica enterica serovar Typhi
aaaagacggcauaagagauaaagaccgaggcgauaaucucaaaacgaaauuuuuuauaggucuggucuaucucuuuuuucucuuuu

SEQ ID NO: 4246037 - RNA, 78 nt, Salmonella enterica enterica serovar Typhi
gggauggcucaaacaucguuuugauaucgaagcgggaagguauuccguucggggaaaagaugauuaugaugcgauccc

SEQ ID NO: 4246038 - RNA, 88 nt, Salmonella enterica enterica serovar Typhi
uguuuuuccugaugacguuucgcuuaucaggccuacaauguuguucgaaccguaggccugaaagcggcgcgucaucaggcaggggaca

SEQ ID NO: 4246039 - RNA, 60 nt, Salmonella enterica enterica serovar Typhi
gcgcgcugcgccaguugcuccggcccaagcucuuccgccggagcauuaauggugucgcgc

SEQ ID NO: 4246040 - RNA, 84 nt, Salmonella enterica enterica serovar Typhi
ugguaagagagccuuacaggcgcaucagaaaaaccuccggcuaugccggaggauauuuauuuuaugcgccgcugggcuucgcca

SEQ ID NO: 4246041 - RNA, 71 nt, Salmonella enterica enterica serovar Typhi
acgcuuaucaggccuacagaauauaguggcaaccuggugauauugcauacccuguaggcccgguaaggcgu

SEQ ID NO: 4246042 - RNA, 88 nt, Salmonella enterica enterica serovar Typhi
ugcguaaaguacaaguaucuaucgaugcauuaaauaccagaaguauuauguaucagucgaugcuggaugaugaaauguauaaaaugca

SEQ ID NO: 4246043 - RNA, 105 nt, Salmonella enterica enterica serovar Typhi
ccuuuuacgcuggguaaaagagaaugagccgcagcgcuacgcgcagauaggcagcgucaugaugacgcaugacuaucugcgcuggugcuuaaccggcgugaaagg

SEQ ID NO: 4246044 - RNA, 84 nt, Salmonella enterica enterica serovar Typhi
cggcaaagaauacgaggucaacggcgcggacaaccugcuacaggcaugucugucccucggccuugauauuccguauuuuugcug

SEQ ID NO: 4246045 - RNA, 64 nt, Salmonella enterica enterica serovar Typhi
aaauguuggcgaccugaugcagcgucuacaaaaaaugaugccugcgcauauuacgccggcguuu

SEQ ID NO: 4246046 - RNA, 101 nt, Salmonella enterica enterica serovar Typhi
ccggauggcgcuaaugcuuauccggccuacucacugcaacgcgaaugauuuugcguauucguuuucgcacgcguaggcccgguaagcgucagcgccaccgg

SEQ ID NO: 4246047 - RNA, 60 nt, Salmonella enterica enterica serovar Typhi
gcgcucgcggacgucgaggaucugguuguuaaucagaccuucuucgauuucgcgcagcgc

SEQ ID NO: 4246048 - RNA, 66 nt, Salmonella enterica enterica serovar Typhi
cauuaggcugagucccccaaagguucgcgagacgugacgaugcgccauggcgggacacagucuaug

SEQ ID NO: 4246049 - RNA, 65 nt, Salmonella enterica enterica serovar Typhi
uuggguuuguaggccggauaagcacugcgccauccggcagucguucauccagccaacaaacucaa

SEQ ID NO: 4246050 - RNA, 57 nt, Salmonella enterica enterica serovar Typhi
gcugcuguuucucgugaugaaggcgcguaugcacgccuucgucgcguuaauggucgu

SEQ ID NO: 4246051 - RNA, 86 nt, Salmonella enterica enterica serovar Typhi
uucuugauguguuuuuuauauauagcugauuauuauucugaaaugucaauuuuugaauaacgacgcugugauaccggcaccaggga

SEQ ID NO: 4246052 - RNA, 94 nt, Salmonella enterica enterica serovar Typhi
gcgguuaauucugugccuggguuaucgcgcgucguaaugauauucacuacgccgccgauagcaucggaaccauaaauagcggaacgcggaccgc

SEQ ID NO: 4246053 - RNA, 58 nt, Salmonella enterica enterica serovar Typhi
ugcggguucaaagcgucaaugugcgccagcgucagcgcaucauugcgccgaaccugca

SEQ ID NO: 4246054 - RNA, 63 nt, Salmonella enterica enterica serovar Typhi
cguaggcgggauagccguuuuuuucgccacgucggcgggcagcaugauguauccuggccugcg

SEQ ID NO: 4246055 - RNA, 114 nt, Salmonella enterica enterica serovar Typhi
cggcaguucaggccagaugacguccggcgcugugcugguaucuguugccguuaccgcgucaauauaauccagcacagcguuaagucggguguuuucuggcugcgucagcuuccg

SEQ ID NO: 4246056 - RNA, 108 nt, Salmonella enterica enterica serovar Typhi
cggcggcuaucugguggugauauuccagagaaucuauagggucgucggugguuccgaccauccgcacauucaucugcugcauaauaccgcgcgcggaaaaggccggcg

SEQ ID NO: 4246057 - RNA, 82 nt, Salmonella enterica enterica serovar Typhi
uugauaaaguacaggauguucggcguaucgugcagaacggcgucugcgcgguuggugccuaauuccauguacgcguuaucaa

SEQ ID NO: 4246058 - RNA, 84 nt, Salmonella enterica enterica serovar Typhi
cuggucacguuuagcggccugcuggucucauuguuuuucgccgcccugguggauuacguggugcgcggcagccguuuuuaucag

SEQ ID NO: 4246059 - RNA, 56 nt, Salmonella enterica enterica serovar Typhi
ggagcggcgcaucacgcugaugauggauaaacauaugucgcaguuaccgccguucc

SEQ ID NO: 4246060 - RNA, 69 nt, Salmonella enterica enterica serovar Typhi
gacccguaaccggcuggccuggcgaacgauucgcugaauggucgcuucaccuugcugccguugcgucuc

SEQ ID NO: 4246061 - RNA, 77 nt, Salmonella enterica enterica serovar Typhi
gaucauguucuggggauuugugggaauugaggcuuuuacgcauuugucgucugaauuuaaaaauccugaacgugauu

SEQ ID NO: 4246062 - RNA, 127 nt, Salmonella enterica enterica serovar Typhi
ccuucaucuuucuccuguucgcuguccagaaucgcaaacaacgucugacaagccgccaucccacgcuggaacugcgcguuaacguuugucagcgauuuuaauggacgcaucagcgcgaucauggagg

SEQ ID NO: 4246063 - RNA, 71 nt, Salmonella enterica enterica serovar Typhi
gcuggucgacgccugcuacagcccuguagagcguauugccuacaauguugaagcagcgcguguagaacagc

SEQ ID NO: 4246064 - RNA, 90 nt, Salmonella enterica enterica serovar Typhi
ggcagaguaugacagcggcgagauugucaucgacccgaaagaacuguuggaagcaaauugguaccguuaugacgaucugccgcuacugcc

SEQ ID NO: 4246065 - RNA, 62 nt, Salmonella enterica enterica serovar Typhi
cgcgaugggcguaaacaucaaccguuccuucaaacacuacggcugguguacguugauucgcg

SEQ ID NO: 4246066 - RNA, 56 nt, Salmonella enterica enterica serovar Typhi
ccugaaaaaggguaacgggacacugccggugguggugccguuacuguuuuaucagg

SEQ ID NO: 4246067 - RNA, 128 nt, Salmonella enterica enterica serovar Typhi
ggauuauuugacgcacagcgucguugcagcgaccuuaacucugccguuuauaaguauuacgacaauauaaagaagcguugucugaacggagaaaaggugccguauucggauuuggacguccuuaauuu

SEQ ID NO: 4246068 - RNA, 126 nt, Salmonella enterica enterica serovar Typhi
cgcagcccguugucagguaacgcccaucguuuauuucaccguucccuuauauguugcgcuuaugucgauacaucaggcgguaguaucagggaaaagguguauaacgcggcguugucgugugucgcg

SEQ ID NO: 4246069 - RNA, 105 nt, Salmonella enterica enterica serovar Typhi
gacacgccuuuacuggauaaguugcgcucaaugaccuggccaauuuuuacgccauguaaaauuaacggcuggcccgguucgaugccguaacuuuccggggccguc

SEQ ID NO: 4246070 - RNA, 72 nt, Salmonella enterica enterica serovar Typhi
aaugcagacggguuauguuaucauuuguacucguguaacaguacaaacggcgguauaacaugacccagcauu

SEQ ID NO: 4246071 - RNA, 97 nt, Salmonella enterica enterica serovar Typhi
gugguaucgacaaagcgguugcugcugcgguugaagagcugaaggcgcuguccguaccgugcuccgacucuaaagcgauugcucagguagguacuau

SEQ ID NO: 4246072 - RNA, 65 nt, Salmonella enterica enterica serovar Typhi
caauaucuacaaaggucguguaagucguguacuuccagguaugcaggcggcuuuuguagauauug

SEQ ID NO: 4246073 - RNA, 57 nt, Salmonella enterica enterica serovar Typhi
ugcugguaugacgcgccguuaagccgcugcucccacucugcggcgcgguuaccggca

SEQ ID NO: 4246074 - RNA, 71 nt, Salmonella enterica enterica serovar Typhi
cggcgggagggguaggcaaaagacgcagaauggaaagcgccgucacgcuuuuuccugacccugacucgccg

SEQ ID NO: 4246075 - RNA, 63 nt, Salmonella enterica enterica serovar Typhi
gugcgcuucuucaccgaacagaagugccggaugaugccguaucuguaucgggaagcggcgcgc

SEQ ID NO: 4246076 - RNA, 82 nt, Salmonella enterica enterica serovar Typhi
gccccggccacauuuccuacguuaucgagccgguggaacggcuguagcgccagauggauguguucauuaucaaugccggggc

SEQ ID NO: 4246077 - RNA, 130 nt, Salmonella enterica enterica serovar Typhi
gcgguugugaaaaugcugauggcguaauauuuugugccggauggcggcgccugcacguugcgaucuuguaggccaaccgccauccggcaucauaacgacauuauuuagacagcgucgcuaccauuaccgc

SEQ ID NO: 4246078 - RNA, 97 nt, Salmonella enterica enterica serovar Typhi
uaccguggcgcauggcgugaagcaacgguaagguagguuugcccucauugaggucaucacccacauuuuuaccgagaugcucgccgucggcacugua

SEQ ID NO: 4246079 - RNA, 59 nt, Salmonella enterica enterica serovar Typhi
cgccguugaguaauacggcuccugggcauaauccgucagaccggugauauucagcggcg

SEQ ID NO: 4246080 - RNA, 74 nt, Salmonella enterica enterica serovar Typhi
gccaguuguuuuagugugguaauuaaccccugugggccaaguucagccaacuuauuauacagugagccacuggu

SEQ ID NO: 4246081 - RNA, 68 nt, Salmonella enterica enterica serovar Typhi
gugguuuauccgcagauccagcacggccuugaaguuauccagcgcccgcuucaucugaggauuuuuac

SEQ ID NO: 4246082 - RNA, 67 nt, Salmonella enterica enterica serovar Typhi
guuacgcgcuuugcguaaggucguuacggcgcaaacgcguauuaucgccggcgcgaaagcgcgugau

SEQ ID NO: 4246083 - RNA, 61 nt, Salmonella enterica enterica serovar Typhi
cguacucugggggaggguauugcgcagcuuuuauccgcgcagauccuggccgggcaguaug

SEQ ID NO: 4246084 - RNA, 78 nt, Salmonella enterica enterica serovar Typhi
ugaacuaucacguuaucuauuuguauggcugacguuuauuggcgccaucguugcauuuauggauaacgcucacguuca

SEQ ID NO: 4246085 - RNA, 62 nt, Salmonella enterica enterica serovar Typhi
cagaugccugauccagacgaauaagcccacccagcuuaauguuuggauuaaucaggcaccug

SEQ ID NO: 4246086 - RNA, 73 nt, Salmonella enterica enterica serovar Typhi
aaucggcgccagaucggugaucauccagucaaaguccagaucgagacuuuguucaacgacuuguguggcgauu

SEQ ID NO: 4246087 - RNA, 56 nt, Salmonella enterica enterica serovar Typhi
gcaacagaucgacacgcacaauaucggaagcgaucaugagcucgucgauuugcggc

SEQ ID NO: 4246088 - RNA, 74 nt, Salmonella enterica enterica serovar Typhi
uguaggccugauaagcgcagcgccaucaggcaaccugcaccgccggauggcagcuucgccuuauccggccuaca

SEQ ID NO: 4246089 - RNA, 66 nt, Salmonella enterica enterica serovar Typhi
gcguggugauuaccguucccgccuauuucgaugaugcccaacgucagggaacgaaagacgccgcgc

SEQ ID NO: 4246090 - RNA, 67 nt, Salmonella enterica enterica serovar Typhi
cgcgcugauggcguucuucggcgacccgucgaccacuuugucggaguaggccagauacgccagcgug

SEQ ID NO: 4246091 - RNA, 82 nt, Salmonella enterica enterica serovar Typhi
gggauuugaauuuggcgucuuccaguggcacgccgacggcucgucaaccgucgcgaaguaaugccagaagauaaguuauccc

SEQ ID NO: 4246092 - RNA, 97 nt, Salmonella enterica enterica serovar Typhi
gauaaaaggcauggugcggcgcgacgguuugcaaaugggugauaggguccgguucaucgccauacggcagacgcgcgcccggcguagugccgauauc

SEQ ID NO: 4246093 - RNA, 96 nt, Salmonella enterica enterica serovar Typhi
cugauaaaaauguaggccugauaagcgcagcgccaucaggcaaccugcaccgccggauggcggcuucgccuuauccggccugcaugcacuuaucag

SEQ ID NO: 4246094 - RNA, 59 nt, Salmonella enterica enterica serovar Typhi
agcauuuucagacgaucgcccagguucuucagcguaucgcgaucgcucugcgagacgcu

SEQ ID NO: 4246095 - RNA, 107 nt, Salmonella enterica enterica serovar Typhi
cagcaugcgguuacgacuggugaaauuagcccgguagguggaugcugagugcugguuaggugucugcaucccuacgcgggcaauaaaauucucauaaccaucagcug

SEQ ID NO: 4246096 - RNA, 68 nt, Salmonella enterica enterica serovar Typhi
ccgaccgugagaaucgaucagcuuaaagggauuaucagaaggcuugauacugaggauuuucgcguugg

SEQ ID NO: 4246097 - RNA, 80 nt, Salmonella enterica enterica serovar Typhi
gacccuggcgcgguuggccggugaucguucaauaaugcgaauaugaaugguuaccagccgcugcgaauucuaccuggguc

SEQ ID NO: 4246098 - RNA, 64 nt, Salmonella enterica enterica serovar Typhi
cagcuaacgguugcauaaucuggacaucuuccuuccugaagccggauuucuggcgcuguuguug

SEQ ID NO: 4246099 - RNA, 79 nt, Salmonella enterica enterica serovar Typhi
guuguggcaggaugugcuguucgauguagccaaucagcaaccgcgcgcccguuucaugcauuggacagcacgccacaau

SEQ ID NO: 4246100 - RNA, 66 nt, Salmonella enterica enterica serovar Typhi
cacacguuuuuguugcgcgucgauaaacaguaaugccgcuuuuaaucccgccagcgaaagcgucug

SEQ ID NO: 4246101 - RNA, 60 nt, Salmonella enterica enterica serovar Typhi
ggcuuacaccugucagcggcgauccggauuaugacgaggcgcucgacaggcuguuaagcc

SEQ ID NO: 4246102 - RNA, 63 nt, Salmonella enterica enterica serovar Typhi
ugaacuucgcgaacaguacgguuuucaguugcugcaucucaccugcugucgcgauacgguuga

SEQ ID NO: 4246103 - RNA, 60 nt, Salmonella enterica enterica serovar Typhi
gcugugucaguuuauucuuuccucaaagacuucugcaggugagggaauuacuggcgccgu

SEQ ID NO: 4246104 - RNA, 59 nt, Salmonella enterica enterica serovar Typhi
uggguuggacggcaggucaucaccagcaaaacgcggcugauacugcucguucaacgcca

SEQ ID NO: 4246105 - RNA, 69 nt, Salmonella enterica enterica serovar Typhi
cuguaucaggcgaucguugaucauguuccggcgccggacguugaccucgaugguccguugcagaugcag

SEQ ID NO: 4246106 - RNA, 100 nt, Salmonella enterica enterica serovar Typhi
gcgauuuccgccagaugcgcuuguugcgucaggcuaaaacuauuggugugauacgcugugaaguuagccguggcggacaacggcgcauaaggcggaucgc

SEQ ID NO: 4246107 - RNA, 59 nt, Salmonella enterica enterica serovar Typhi
aaaucgcuauagaugauuucgguacaggccauagcgcccugauuuaucuggagcgauuu

SEQ ID NO: 4246108 - RNA, 81 nt, Salmonella enterica enterica serovar Typhi
cucucaguugaccgacgaagcagauuuuagcccacgcaaggcgcugcauaacccagauuugcuugaguuguuuagcuggag

SEQ ID NO: 4246109 - RNA, 63 nt, Salmonella enterica enterica serovar Typhi
cggagcugauggagcuggugggugaagaugacauucugauccugaccgcugaccacggcugug

SEQ ID NO: 4246110 - RNA, 67 nt, Salmonella enterica enterica serovar Typhi
gcccgcugggucgugcuauguuccguaaacugaaaguuuacgcgggcaacgagcacaaccacgcggc

SEQ ID NO: 4246111 - RNA, 81 nt, Salmonella enterica enterica serovar Typhi
gugauaugggaccgguuguucaaaguguaguaacguuguguuuuuuuauaacucccaucauuugaacaucggaacaauuac

SEQ ID NO: 4246112 - RNA, 65 nt, Salmonella enterica enterica serovar Typhi
ugagcaugcucuugcaaacuggguuccggcggaggaggcggcgcucaucagcgcggguauguuca

SEQ ID NO: 4246113 - RNA, 75 nt, Salmonella enterica enterica serovar Typhi
ugacuuucaaaccucuguaacgucaaccaguccucaaccggacugguucuucuguuauagggauuuuagcacuca

SEQ ID NO: 4246114 - RNA, 67 nt, Salmonella enterica enterica serovar Typhi
aguaagauggggaaagcaugagcaccauucugauuuuuauagcugcuuugcuggccugcucucuacu

SEQ ID NO: 4246115 - RNA, 60 nt, Salmonella enterica enterica serovar Typhi
uggcucuuuugcggcguggaaucucgugcuaucacagauaucacagccagaaaagggcua

SEQ ID NO: 4246116 - RNA, 55 nt, Salmonella enterica enterica serovar Typhi
agguugguggucaguggugguuauuacgggguaaugccaaccgcugccgccacuu

SEQ ID NO: 4246117 - RNA, 66 nt, Salmonella enterica enterica serovar Typhi
gguuuuacuacccuggauucuuguauauucaacuucaacgguauugacauaauccggguaaagacc

SEQ ID NO: 4246118 - RNA, 58 nt, Salmonella enterica enterica serovar Typhi
ggccaguuuucaugaugcgguagccgcaguggguuuuccuugcaucgucaaaccgguc

SEQ ID NO: 4246119 - RNA, 81 nt, Salmonella enterica enterica serovar Typhi
cuuuuuagcggcggcgucguaaauaggccgcgcuuccgcuuucgccugcguaaccugccauuugccgcugucguuauugag

SEQ ID NO: 4246120 - RNA, 78 nt, Salmonella enterica enterica serovar Typhi
ggccgcaccauucccugauaaaacaguaacggcaccaccaccggcagugucccguuacccuuuuucaggugggcaucc

SEQ ID NO: 4246121 - RNA, 84 nt, Salmonella enterica enterica serovar Typhi
ggcgaagagcuggaaacgcugugucaugccgguauuccuuucucaguaguaccggggauuaccgcggcuuccggcugcuccgcc

SEQ ID NO: 4246122 - RNA, 119 nt, Salmonella enterica enterica serovar Typhi
gcggaaauucgccgacugaacgggcgucgcgucgagcuggagcgcgcgcuggcgacgcaugaaagcgacaaccagcagcagcgccuucaguuugagcaggccaaagagggcguuuccgc

SEQ ID NO: 4246123 - RNA, 80 nt, Salmonella enterica enterica serovar Typhi
accaaaaacugaaugacaccgguguccuggcaggaaggucgauccagcucuuucgccagacgcugguucucaaucauggu

SEQ ID NO: 4246124 - RNA, 69 nt, Salmonella enterica enterica serovar Typhi
gacuggcaucgccauccacagguaaaagccaacggacuguugaucaaccugcugauggcggcagccguc

SEQ ID NO: 4246125 - RNA, 81 nt, Salmonella enterica enterica serovar Typhi
accgagaaaguugguuuugcuaacuacugucuggcggauuuugucgcgccgaaacugagcggcaaagcggacuacaucggu

SEQ ID NO: 4246126 - RNA, 61 nt, Salmonella enterica enterica serovar Typhi
uugaccgugcuggcauucgccgucaacgacagcgacgggcggcgcacguccacacgguuaa

SEQ ID NO: 4246127 - RNA, 68 nt, Salmonella enterica enterica serovar Typhi
cgccgcaggaauacauaggacaccaucugaauaaccuucagcuggaccugcguacuuucucgcuggug

SEQ ID NO: 4246128 - RNA, 80 nt, Salmonella enterica enterica serovar Typhi
gaacgggcugcggcaagcuggcgaucguucgauagugcgaguauugaauggcugccaguugcggcggauuuuacuuguuc

SEQ ID NO: 4246129 - RNA, 81 nt, Salmonella enterica enterica serovar Typhi
gccaucuuuggcgguaaagguaauggauucagcuucggcagggguugguccauagacuuuauuguccggguaauaaaaggc

SEQ ID NO: 4246130 - RNA, 60 nt, Salmonella enterica enterica serovar Typhi
uguucacacuguucaccucugguuuuuuaucaauaauuucauggugauacagggugaaua

SEQ ID NO: 4246131 - RNA, 88 nt, Salmonella enterica enterica serovar Typhi
cgcucacguccaugauuuugucuggugccaggaagagccgcucaaccagggcgcaugguacugcagucagcaucauuuccgugaagug

SEQ ID NO: 4246132 - RNA, 90 nt, Salmonella enterica enterica serovar Typhi
ggguggggauugccauuggacuugccgggauuauucugcugaacagcggcgguaauuuaagcggcaauccguggggcgcgauuuugaucc

SEQ ID NO: 4246133 - RNA, 67 nt, Salmonella enterica enterica serovar Typhi
gcgacgccguuggaacguucuuugggacgcauugcaggcgucaaugaaaugacuuccagcagcucgc

SEQ ID NO: 4246134 - RNA, 57 nt, Salmonella enterica enterica serovar Typhi
ugguaaagcaaucgucaaaaccacgcggauagugguauucgaaauugucuuuaucca

SEQ ID NO: 4246135 - RNA, 61 nt, Salmonella enterica enterica serovar Typhi
aagcgucgccgggggauauaaccucgcguacaacguggcuguugugccgccggcgaagcuu

SEQ ID NO: 4246136 - RNA, 69 nt, Salmonella enterica enterica serovar Typhi
ugcuggcgaugcgucucugaacaggcggccucacagguguggcagccgauacagagaguggagucagca

SEQ ID NO: 4246137 - RNA, 84 nt, Salmonella enterica enterica serovar Typhi
acaacacgaaggcgcauuuccgguauccauaaagagucggucuugucuguuaaauuuaaauggugggagugcgccuccgguugu

SEQ ID NO: 4246138 - RNA, 86 nt, Salmonella enterica enterica serovar Typhi
ucgcgcuggaaaaaacuggauaauuuuauugaucguccgguaaaacuaauuauuggcgacaaagaaauauuugguauuucccgcgg

SEQ ID NO: 4246139 - RNA, 78 nt, Salmonella enterica enterica serovar Typhi
ggccuggagccgcugaacauuggugacgauagccuguuugucaacgucggcgaacguacuaacgucaccggcucggcc

SEQ ID NO: 4246140 - RNA, 90 nt, Salmonella enterica enterica serovar Typhi
caccaauggcccgaacaaagaaaguugaacuggggcgacguauacaauacgcauucagauccagcucuucuucuguauagucaguugcug

SEQ ID NO: 4246141 - RNA, 61 nt, Salmonella enterica enterica serovar Typhi
acugcuugaugaggccgaacgucugggaucgacaucugcccguuccaccuuuaucagcagu

SEQ ID NO: 4246142 - RNA, 86 nt, Salmonella enterica enterica serovar Typhi
gagcccgucaauuugucgauagcuauuaccgcacauggggaggacgcuaugugcaguuugcgaucgaauuaaaagaugacuggcuc

SEQ ID NO: 4246143 - RNA, 67 nt, Salmonella enterica enterica serovar Typhi
ucgguauggcaugaugcggaaucggcauuguauucauagacuuucagcccgcguucauccaugcaga

SEQ ID NO: 4246144 - RNA, 66 nt, Salmonella enterica enterica serovar Typhi
gaugcggcgcuuuccuggcuguuagaauacgcgccgucgcgccugacugggacaggggccuguguc

SEQ ID NO: 4246145 - RNA, 61 nt, Salmonella enterica enterica serovar Typhi
gagcuucaauacggcgaucggcuucagccauugccugaggcugaucagcugcauuggguuc

SEQ ID NO: 4246146 - RNA, 74 nt, Salmonella enterica enterica serovar Typhi
gcggcgcuguacgguauuucauucacagugugagucaauauuacuucgcuaucaggaugaggaccgcgggcugc

SEQ ID NO: 4246147 - RNA, 55 nt, Salmonella enterica enterica serovar Typhi
gucguuuuuugccgccugaacgcaaugauuuugugaucaauuucaaagaagcgac

SEQ ID NO: 4246148 - RNA, 57 nt, Salmonella enterica enterica serovar Typhi
ucgccccugccgagauugagcuuaaugccguuauuaagcgucaauugccaggagcga

SEQ ID NO: 4246149 - RNA, 59 nt, Salmonella enterica enterica serovar Typhi
uaaugccguuaacgguaauuucgccuuuuugcaccgguuccagaccguugacggucuua

SEQ ID NO: 4246150 - RNA, 89 nt, Salmonella enterica enterica serovar Typhi
ucgcuuuagcuccgccugcaucgcguuuauuaaacaguggcagggucugucgcuggaaaaguaucgcgaucggcaggguaacuggguga

SEQ ID NO: 4246151 - RNA, 59 nt, Salmonella enterica enterica serovar Typhi
acuuucuggcccacuucgaugaacgcuuucgcguccgggcuuggggugcgguagaaagu

SEQ ID NO: 4246152 - RNA, 67 nt, Salmonella enterica enterica serovar Typhi
ucccuguguccugugcgguaaucugcugcuaucgagaacgacagauaucgcuaacaguauauaugga

SEQ ID NO: 4246153 - RNA, 57 nt, Salmonella enterica enterica serovar Typhi
gaugucgauacgcuggcggauaugguggugaaaaccgcacagccuggcgaucacauc

SEQ ID NO: 4246154 - RNA, 57 nt, Salmonella enterica enterica serovar Typhi
cggguauaucugacggagcgugauacucaaaugaucauggaaauuuuagauaacccg

SEQ ID NO: 4246155 - RNA, 96 nt, Salmonella enterica enterica serovar Typhi
gcgcgacggucgccaggaaguuaugcggguuuggcggacaaccuggaauauugauaaccguuuugcccgguaagacuuccugcagacugacagcgc

SEQ ID NO: 4246156 - RNA, 85 nt, Salmonella enterica enterica serovar Typhi
cagggccguugucgcugguaaagaugacgaugguguuaucuuccucgcccaucgccuuaauuuuauccagcacuuuaccgaccug

SEQ ID NO: 4246157 - RNA, 68 nt, Salmonella enterica enterica serovar Typhi
acucaacgcgcugguguuugacuuuucgcucagcaagaguaaagugaaauaauucagucaguugaagu

SEQ ID NO: 4246158 - RNA, 67 nt, Salmonella enterica enterica serovar Typhi
ggcagagcggcuggcgaaacuggcgcuggaugagcuuccucucgccugguuuuauagccgcauuguc

SEQ ID NO: 4246159 - RNA, 59 nt, Salmonella enterica enterica serovar Typhi
guagcagagcgugcagucccgcgugauugcuguuuccgcauaucugccuguucugcuau

SEQ ID NO: 4246160 - RNA, 66 nt, Salmonella enterica enterica serovar Typhi
ucuggagcgcgguaucgcugagcuccucggcacauuacgcgccggggaucaguauaccucgucaga

SEQ ID NO: 4246161 - RNA, 60 nt, Salmonella enterica enterica serovar Typhi
ugccuucgcgauccagccagacgcugacaucaaucugugucucuuugguguugcggacca

SEQ ID NO: 4246162 - RNA, 61 nt, Salmonella enterica enterica serovar Typhi
gaaugucugaagacagaggaguacguccgacauuuuuuuccuuaucuguuuccagacauuc

SEQ ID NO: 4246163 - RNA, 66 nt, Salmonella enterica enterica serovar Typhi
aaguggcugggguacgaggauucgaaccucggaaugccggaaucagaauccggugccuuaccgcuu

SEQ ID NO: 4246164 - RNA, 71 nt, Salmonella enterica enterica serovar Typhi
ccaaccuguuuaucgccagcaugguuguucuggugcuguccgauaaccugcuguugauguaccucggcugg

SEQ ID NO: 4246165 - RNA, 62 nt, Salmonella enterica enterica serovar Typhi
uguucguuggugauggcgggcgguuugccgcucagguugccggaugucaucaccagcgggua

SEQ ID NO: 4246166 - RNA, 80 nt, Salmonella enterica enterica serovar Typhi
uggcacagaugaacuauggcgguugcguggccgccugcggccuggcgggcggcuucgcgcugccgaccaccguuaugcca

SEQ ID NO: 4246167 - RNA, 82 nt, Salmonella enterica enterica serovar Typhi
gugguaugucaucauccaucugaccuuuguccugucggcguucgugaugggcuaucuggacagauugacgcgacauaaccau

SEQ ID NO: 4246168 - RNA, 77 nt, Salmonella enterica enterica serovar Typhi
gcuuuugcguacguugacuacgcugaaaaauggacggcuaaacuggucguaccacaauuagcguauuaacggagagc

SEQ ID NO: 4246169 - RNA, 57 nt, Salmonella enterica enterica serovar Typhi
cggauuuccgcaacguggugcuggugaugaccaccaacgccggcgugcgagaaaccg

SEQ ID NO: 4246170 - RNA, 92 nt, Salmonella enterica enterica serovar Typhi
gaaaucgauucuucguugcugauacggcgaaucgcuucggccagcauaccugacagggucaaaguacgcacguucggcagcgcuuugauuuc

SEQ ID NO: 4246171 - RNA, 59 nt, Salmonella enterica enterica serovar Typhi
gaacuggauuaagcgggcugcguguccucuucgcggacgcggaacacguuaaccagcuc

SEQ ID NO: 4246172 - RNA, 63 nt, Salmonella enterica enterica serovar Typhi
ugcgcagcgccggagacgaagacgcccucgcgguaaaacuuuuugucuccgccugcugcggca

SEQ ID NO: 4246173 - RNA, 63 nt, Salmonella enterica enterica serovar Typhi
ugaacggcgcuauugucgggaugaccaccuucggugaauccgccccggcagagcugcuguuug

SEQ ID NO: 4246174 - RNA, 66 nt, Salmonella enterica enterica serovar Typhi
gaugaacauacguuuggucacgguaaagcggagucgcuggcggcgcuggcgcaaaguauguuuauu

SEQ ID NO: 4246175 - RNA, 69 nt, Salmonella enterica enterica serovar Typhi
agcagauaguuauucgcaucgcgcuuuugcagaucguaagcuggcgucgcagcgacuggcguaucuccu

SEQ ID NO: 4246176 - RNA, 62 nt, Salmonella enterica enterica serovar Typhi
ggugagggcagaucagcaccucaucaaagcauacgcccugagaagugaaaaucugcaucauc

SEQ ID NO: 4246177 - RNA, 56 nt, Salmonella enterica enterica serovar Typhi
uccagcaaaaaucuuucuuuggagagugcgaucgauaaagagagugacuugcugga

SEQ ID NO: 4246178 - RNA, 60 nt, Salmonella enterica enterica serovar Typhi
cgcggggacguuuuugaucgucauuccacaacuuaguggugauaaacagcucuucccgcg

SEQ ID NO: 4246179 - RNA, 75 nt, Salmonella enterica enterica serovar Typhi
gauauugaggaugugaaucugaacucggugcuuaaaggcauuggcgcgcagauucgcagcgacgauccguauauc

SEQ ID NO: 4246180 - RNA, 78 nt, Salmonella enterica enterica serovar Typhi
cugucuguccuaucuggcuguagacucgcuuucccugcugguacagggaaagcaguguacgcgccuuugacgugacag

SEQ ID NO: 4246181 - RNA, 71 nt, Salmonella enterica enterica serovar Typhi
gccugcaucauuuccauaacggcggcggucagcgggagcugcgcgccaacgccgugggagguauccagcgc

SEQ ID NO: 4246182 - RNA, 55 nt, Salmonella enterica enterica serovar Typhi
agaggcuaauuaucugccagccgauuuuucggcacgcuggcggcguaaugcuuuu

SEQ ID NO: 4246183 - RNA, 116 nt, Salmonella enterica enterica serovar Typhi
gcgccuccguuugcugacauaguaugagguugauauugcccggcggcgcacuaccugccgggcaacguagagcauuauugggucacgucagcgccaaaccauuuuucggagagcgc

SEQ ID NO: 4246184 - RNA, 74 nt, Salmonella enterica enterica serovar Typhi
aaugagcugaccacugacgaaaagcgggaguugauuaaagcaaugaaucauuuucgugcaguggugagcuuauu

SEQ ID NO: 4246185 - RNA, 60 nt, Salmonella enterica enterica serovar Typhi
gugugaauggaaaaacguacgaauucuggaagcagaauguugcgcagaucauauucacau

SEQ ID NO: 4246186 - RNA, 86 nt, Salmonella enterica enterica serovar Typhi
gcauuauccgccgcgcuuugggggagugcaacccaggcugccgacgccgccguugucgcuucgcuuaaaccgcuuggguuuauugc

SEQ ID NO: 4246187 - RNA, 64 nt, Salmonella enterica enterica serovar Typhi
gugucuggcggaguacaaauuucgaaucuaaaaauuacagauuuuggaauagcuacgcuaacac

SEQ ID NO: 4246188 - RNA, 125 nt, Salmonella enterica enterica serovar Typhi
gcgguaauccggauuaacauacuuugcgaacuguugggcuuuuagcggcguccaggcgcgauucgcauccagacgcagaugcagauccgggaucgccuccagcagcaaauuaaccaccaugccgu

SEQ ID NO: 4246189 - RNA, 75 nt, Salmonella enterica enterica serovar Typhi
cguagccggcagauaacccucaaccacgauaacggcaacuggcugaaguauggucagggauauaugccgguuaug

SEQ ID NO: 4246190 - RNA, 72 nt, Salmonella enterica enterica serovar Typhi
agauuaaauagcuuuaucucuaaagcgggcauuaugguaauggccacucaugaugaugaacuggcuaaaucu

SEQ ID NO: 4246191 - RNA, 79 nt, Salmonella enterica enterica serovar Typhi
aacgcgcucugcgcgcggauaaaaugacgcuggcggcgcuggaggcaacguuacgucuguaucugcacccggaagcguu

SEQ ID NO: 4246192 - RNA, 63 nt, Salmonella enterica enterica serovar Typhi
guuugguuucucaguaagggaauagugugaugcguaguacacaccaauuuuuuauuaccaaac

SEQ ID NO: 4246193 - RNA, 87 nt, Salmonella enterica enterica serovar Typhi
cagcuuuuuacguagcucgugcgcauuagucagguugccauuaugggccaacgugaugccauacggcgaguuaacguaaaaagguug

SEQ ID NO: 4246194 - RNA, 72 nt, Salmonella enterica enterica serovar Typhi
ggcagcggcgaggucauggaaguguaaggaugccaaauauggcguuuaucgaaggccagaucguccguuguc

SEQ ID NO: 4246195 - RNA, 68 nt, Salmonella enterica enterica serovar Typhi
cuucuucggcaucagguuaaggauaaguaccuuuagcgggcgaauuuccugaccugaugcgcgagaag

SEQ ID NO: 4246196 - RNA, 60 nt, Salmonella enterica enterica serovar Typhi
agcgcgauugauaugaauauauuuagcgauccuuuacagccaaauauugucaaucgcacu

SEQ ID NO: 4246197 - RNA, 57 nt, Salmonella enterica enterica serovar Typhi
ugauggcgcagcgcauugauguggcggaagagcuggaucgucucgaagcgcacguca

SEQ ID NO: 4246198 - RNA, 86 nt, Salmonella enterica enterica serovar Typhi
guagggaugccgcugcguguggcugugaccggugccggcagucgccugcgcuggaugucaccguacaugcgauugguaaaacccgc

SEQ ID NO: 4246199 - RNA, 55 nt, Salmonella enterica enterica serovar Typhi
cggaguuaaugaugaaacuaaggugauugucccuuccgcuucauuauuaacggug

SEQ ID NO: 4246200 - RNA, 126 nt, Salmonella enterica enterica serovar Typhi
caguacggcauucugccggaagaguggggcggcgagagccaguucguucacgugucugcgaaagcgggcaccgguaucgacgaacugcuugacgcuauccugcugcaggccgaaguucuggaacug

SEQ ID NO: 4246201 - RNA, 57 nt, Salmonella enterica enterica serovar Typhi
gcuggcugaaaacuugauugccacuggcggcgcaguggucucagaauuuccgcuuuc

SEQ ID NO: 4246202 - RNA, 62 nt, Salmonella enterica enterica serovar Typhi
acguccgcuauuggcacagaccugccugucagauuagguuuaggucugugccauagcuaugu

SEQ ID NO: 4246203 - RNA, 55 nt, Salmonella enterica enterica serovar Typhi
gaacauugaugagcaaaacgucauuaccaaugccguuuccugcggcacgauguuc

SEQ ID NO: 4246204 - RNA, 126 nt, Salmonella enterica enterica serovar Typhi
ugaccagcgauauucgcaauauuacuaucgccuuugugcgucugccugagcuggugcagggcauuguccucaccgucggcucggcggcguaucuggcgaugcuaucgacaaaaaugcugcugguua

SEQ ID NO: 4246205 - RNA, 58 nt, Salmonella enterica enterica serovar Typhi
gccagcgucucgacggcgcggcuaucgauaugccagccgggccgucugaagugcuggu

SEQ ID NO: 4246206 - RNA, 79 nt, Salmonella enterica enterica serovar Typhi
ggcgcaggggcaggucagcauagauacgacgcgcugcauagccuguggcgacugucuguuugucuguccuguugacgcc

SEQ ID NO: 4246207 - RNA, 76 nt, Salmonella enterica enterica serovar Typhi
cgaucaucgaggugugcaaagacugauagccguucgcuuugggaauggcgauauagucuuucacgcgucccggacg

SEQ ID NO: 4246208 - RNA, 80 nt, Salmonella enterica enterica serovar Typhi
ugccgucaugaugaugcugacguuacugcuccugugcugguuuuguuuuccggguagggcguuacaguaucauaccggua

SEQ ID NO: 4246209 - RNA, 55 nt, Salmonella enterica enterica serovar Typhi
gucucuuuauccugaagcuguaucgcccccgaauaggcuucaucggugaggagau

SEQ ID NO: 4246210 - RNA, 64 nt, Salmonella enterica enterica serovar Typhi
gcauuuucagcgguugcacgauauucuguucagaccagguuucgugcugccagcggacaaaugu

SEQ ID NO: 4246211 - RNA, 74 nt, Salmonella enterica enterica serovar Typhi
aguguugaugugcaugacagacgagaaugcaacggaucguugucacauucuuaccucuaugcacaauaaauacu

SEQ ID NO: 4246212 - RNA, 65 nt, Salmonella enterica enterica serovar Typhi
uuuaaucuuaucgcaucggcgguggacgggcagcgucgacuuaucgccgucgugaugggagcgaa

SEQ ID NO: 4246213 - RNA, 117 nt, Salmonella enterica enterica serovar Typhi
cguuucagaaauacguuuaacgcuauuaacaacggagaacaguaucuuguggaugagcugaucagcauagauucucguuguccguugcuugaaaagcugaaacuggaacugacaacg

SEQ ID NO: 4246214 - RNA, 84 nt, Salmonella enterica enterica serovar Typhi
gugcgucuggcuuaacguuuccagguuuuugcacaacguuuccggauugcaggaaauguacagaauacguggauaagccugcac

SEQ ID NO: 4246215 - RNA, 65 nt, Salmonella enterica enterica serovar Typhi
guagauuccagccguuugaauguagaaacgaaccugccggaagcguucgaacgcugcgaauuuau

SEQ ID NO: 4246216 - RNA, 59 nt, Salmonella enterica enterica serovar Typhi
ggaauauggucugccgcaugugaaucuggugaaagggaucgcggcggcgaugcauuucc

SEQ ID NO: 4246217 - RNA, 63 nt, Salmonella enterica enterica serovar Typhi
ggcgaaaggccaucacuucccggacgucacgcugguggcguugcuggaugucgauggcgcgcu

SEQ ID NO: 4246218 - RNA, 77 nt, Salmonella enterica enterica serovar Typhi
cgcuuuaucagaauaucuccauuauucgccgcggauuacguaccguuggcgaaaaugaagauacgcugauaaucacg

SEQ ID NO: 4246219 - RNA, 75 nt, Salmonella enterica enterica serovar Typhi
uggcaugaccugcggcaguaucccagacgcuggucggcccaaaucugggguaaagcugcgccuguccuuccgcca

SEQ ID NO: 4246220 - RNA, 62 nt, Salmonella enterica enterica serovar Typhi
ucguauuggccacaccguagagcgcgaggauacuccugcuguucgugguauggucaacgcgg

SEQ ID NO: 4246221 - RNA, 93 nt, Salmonella enterica enterica serovar Typhi
uaauugcuguaggccggauaaggcgaagcugccauccggcggugcagguugccugauggcgcugcgcuuaucaggccuacauuuuuacaguua

SEQ ID NO: 4246222 - RNA, 92 nt, Salmonella enterica enterica serovar Typhi
gugcauacugcgaagucagugcgcgugcgcgaugaacaucgcgugcugcaugugauuccucaggaguacgccauugacuaccaggaaggcau

SEQ ID NO: 4246223 - RNA, 78 nt, Salmonella enterica enterica serovar Typhi
accgaaguggucagcauugagcugccgcgcgauaccaaaggcggcgcgggccacgguucgcugauuauuuuaggcggu

SEQ ID NO: 4246224 - RNA, 55 nt, Salmonella enterica enterica serovar Typhi
cccggaaaccaucauggaugcgcuguuugaacaggggaucaggguggauuccggg

SEQ ID NO: 4246225 - RNA, 67 nt, Salmonella enterica enterica serovar Typhi
gcauugagaaucagucuuccggcgugaucccggugaugaaaaugcuggaagacgcguuuucguaugc

SEQ ID NO: 4246226 - RNA, 67 nt, Salmonella enterica enterica serovar Typhi
cggaacgugauaagcgcccgugagcauccaggcggugauccccuccucauuuagcgcucgcguuuug

SEQ ID NO: 4246227 - RNA, 60 nt, Salmonella enterica enterica serovar Typhi
ccggauauccuggcacugguacaacgcauccacgcggagugcccggggaaagauaucugg

SEQ ID NO: 4246228 - RNA, 63 nt, Salmonella enterica enterica serovar Typhi
ugcuuuaaaugcugcgcuaacucauuaaugagucaguaaaaagcgcaccauuuauaaaaagua

SEQ ID NO: 4246229 - RNA, 64 nt, Salmonella enterica enterica serovar Typhi
gacgauccggugaugauggcaaccgcuuuccgucuggcgguggaagccggauuacuggcgcguc

SEQ ID NO: 4246230 - RNA, 73 nt, Salmonella enterica enterica serovar Typhi
cugcaauuucuauuucuaaaauuauuggcgguugcggcccggcugccgaucaauaauagaaacgacugcgcag

SEQ ID NO: 4246231 - RNA, 55 nt, Salmonella enterica enterica serovar Typhi
uguugcaccaaaauagugcuucaaugugaacauuaagcaccacauuggugcaaua

SEQ ID NO: 4246232 - RNA, 58 nt, Salmonella enterica enterica serovar Typhi
ggccgguuaucaguuuaucgggauggaccauuuugcccguccggaugacgaacuggcc

SEQ ID NO: 4246233 - RNA, 66 nt, Salmonella enterica enterica serovar Typhi
cgcgucuccuuuagcuacgauggcaauacggugacgcugccgguugaaaucucugaaggguuagcg

SEQ ID NO: 4246234 - RNA, 59 nt, Salmonella enterica enterica serovar Typhi
uugaggauucacugggaauggaagugggcuaccgccugaucccgaugguggauuuucaa

SEQ ID NO: 4246235 - RNA, 55 nt, Salmonella enterica enterica serovar Typhi
cgaugauaugccacccgaggaugauccagugcauucagugguaacggugucauug

SEQ ID NO: 4246236 - RNA, 66 nt, Salmonella enterica enterica serovar Typhi
gcguaggcggcgcgaugauggugccggucggacgccugacggucaugaaaaucgugccgcgugcgc

SEQ ID NO: 4246237 - RNA, 87 nt, Salmonella enterica enterica serovar Typhi
ggaaugacgcgccugcgcuaccgcugccggaaucagaucuggugaauaaagcgauggcgcuaagccaggcgguaaaucgucagcucc

SEQ ID NO: 4246238 - RNA, 71 nt, Salmonella enterica enterica serovar Typhi
gugguaauuagugaggauggcgccaguaucagcggcaccgccgaaccggguagcuccauuacgaucaccac

SEQ ID NO: 4246239 - RNA, 62 nt, Salmonella enterica enterica serovar Typhi
gcgccguugcgcacuuuuuuaaguuuuccgcuuucgucgagcuuguugaugucgcggcgcgc

SEQ ID NO: 4246240 - RNA, 56 nt, Salmonella enterica enterica serovar Typhi
gccagcggccugaaagucauuccggauucaaucgcugacuuucccgguccgcuggc

SEQ ID NO: 4246241 - RNA, 65 nt, Salmonella enterica enterica serovar Typhi
gugaucccgguugaugguuugugcgugcgcgucggcgcgcugcgcugucacagccaggcguucac

SEQ ID NO: 4246242 - RNA, 65 nt, Salmonella enterica enterica serovar Typhi
cgccggaucgguuaggccgggcagguaucgacaaaaucggucuuggcgcgcuaauuggucugucg

SEQ ID NO: 4246243 - RNA, 76 nt, Salmonella enterica enterica serovar Typhi
gcuguuaaggcuaaaggcuugcaagaacugguuauucagacugauauccagccgcgaacugucuuuggucggcggc

SEQ ID NO: 4246244 - RNA, 58 nt, Salmonella enterica enterica serovar Typhi
cugaccuuugauggcgacauucgcgaaagcgcggaaguguucgauaccaaaggugaag

SEQ ID NO: 4246245 - RNA, 85 nt, Salmonella enterica enterica serovar Typhi
gacuaucgccgggaaccauuuugacuuuacgaaaacgccguccgauaaggcgauucgugagcuacgucaaaaugucggaaugguc

SEQ ID NO: 4246246 - RNA, 55 nt, Salmonella enterica enterica serovar Typhi
uugaacguuuucugagcggucgugccaaggcaucugcgcaacuggaagcgaucaa

SEQ ID NO: 4246247 - RNA, 69 nt, Salmonella enterica enterica serovar Typhi
ccgcgaucgucugguuaaucgcgcugggugggauguaucuuagccgggcauucaccgcacaaucagugg

SEQ ID NO: 4246248 - RNA, 56 nt, Salmonella enterica enterica serovar Typhi
gggguaaaugugaaauaccguuaugaggaugacucuccgguaaguuuuauuuccuc

SEQ ID NO: 4246249 - RNA, 60 nt, Salmonella enterica enterica serovar Typhi
uacguuugccgaggugaucguacauaaacagaccgauacggaucauccaggcuggacgua

SEQ ID NO: 4246250 - RNA, 64 nt, Salmonella enterica enterica serovar Typhi
cuuaucuguauugaugauaaaccagccaccugucaggcugcuaauuuauuucgguucaggaagg

SEQ ID NO: 4246251 - RNA, 77 nt, Salmonella enterica enterica serovar Typhi
gcagaauggcgaggaacgccuccugaggcagcucgacguuaccgaucugcuucaugcguuucuuaccuucuuucugu

SEQ ID NO: 4246252 - RNA, 83 nt, Salmonella enterica enterica serovar Typhi
aguugcagcggauuauuuuuucgcuugagcgcgacgcccgagaaagagcgaauaaagugcgagaauaaucuucacgcuaaacu

SEQ ID NO: 4246253 - RNA, 90 nt, Salmonella enterica enterica serovar Typhi
gauggcgcuuugcuuaucgggccuacaagaguucaucacaacguauugauauugcaaaucuuguaggucggauaaggcgcagccgccauc

SEQ ID NO: 4246254 - RNA, 67 nt, Salmonella enterica enterica serovar Typhi
cgguugcgccagcccgacguggccuaacgcuucaucgaguugggucacguuuacgcugucgccaucg

SEQ ID NO: 4246255 - RNA, 73 nt, Salmonella enterica enterica serovar Typhi
acauaauaacggcagugaacauucgaagcggcaaguuggcugaaacgaguguugacugccguuuuaguuuugu

SEQ ID NO: 4246256 - RNA, 61 nt, Salmonella enterica enterica serovar Typhi
aguuccugcgcgccgaugaauccccgcugcagcauauggcgcgucuggcgccgcaggaacu

SEQ ID NO: 4246257 - RNA, 90 nt, Salmonella enterica enterica serovar Typhi
gcagguucgaaucuuccauaucgcagauagcaaaaaagcgccuuuagggcgcuuuuuuacauuggugggucgugcaggauucgaaccugc

SEQ ID NO: 4246258 - RNA, 56 nt, Salmonella enterica enterica serovar Typhi
cgucguggugcauggcgacaagcuguuuaucagcuauucggccagcgccaccgaug

SEQ ID NO: 4246259 - RNA, 88 nt, Salmonella enterica enterica serovar Typhi
gcgcuaauugaauguggcgagguguaagaaagcagaaaagcaaaguggguucucguugcucugcaugucgucaaauucaauuaaacgc

SEQ ID NO: 4246260 - RNA, 87 nt, Salmonella enterica enterica serovar Typhi
gguaaugucgauauccguaccgucaauaucagcuuucgcgucggcggcaggcuggcgucgcugaauguugaugaaggcgauacuauc

SEQ ID NO: 4246261 - RNA, 68 nt, Salmonella enterica enterica serovar Typhi
gacucuucaccuuugguaucgaacacuuccgcgcuuucgcgaaugucgccaucaaaggucaggauguu

SEQ ID NO: 4246262 - RNA, 70 nt, Salmonella enterica enterica serovar Typhi
guuuguugguaaugggguauggaugguaucgaauguaggaucgccagccagugcgcuaauacuaucaaac

SEQ ID NO: 4246263 - RNA, 59 nt, Salmonella enterica enterica serovar Typhi
gagcugguuaacguguuccgcguccgcgaagaggacacgcagcccgcuuaauccaguuc

SEQ ID NO: 4246264 - RNA, 100 nt, Salmonella enterica enterica serovar Typhi
uucuggcuuaccugacuaauuaucgcccucacuaaauacguuuuauucgauggugagggguuggugaugagugagaaagaacagguaucaguguccagaa

SEQ ID NO: 4246265 - RNA, 126 nt, Salmonella enterica enterica serovar Typhi
ucggcuccuuugacggcggcuggggcgcuucguauauggcgcguaucguuggucagaagaaagcgcgugaaaucugguuccugugccgccaguacgaugcgcaacaggcgcuggauauggggcugg

SEQ ID NO: 4246266 - RNA, 74 nt, Salmonella enterica enterica serovar Typhi
agaggcaaugguuuuuacaaacguucccaccauauguuccacggugaagcguucuuguaaaaaugacugcgucu

SEQ ID NO: 4246267 - RNA, 90 nt, Salmonella enterica enterica serovar Typhi
gcugcuuuuacgguuucauuuguugccguuaugcaggaacauuuuuccuuugauaccguagcauuggcaauagauaaucguccaaguagu

SEQ ID NO: 4246268 - RNA, 94 nt, Salmonella enterica enterica serovar Typhi
ggauuugcuuaccugucagcguauggcugcaagacgguacaggaggcgaucacuuaccgugaaaacuucagccagcgcgaagggaugcugaucu

SEQ ID NO: 4246269 - RNA, 82 nt, Salmonella enterica enterica serovar Typhi
guuuaucgucuggcuggagucucagggcgcauucaaucacccuuacuggaugugucguggcuccuggucuuacgcuuauaac

SEQ ID NO: 4246270 - RNA, 66 nt, Salmonella enterica enterica serovar Typhi
uguuuguaacuuuucaucauuacuguuuccuucccgaggggauaguacgauggaaggccgcaaaua

SEQ ID NO: 4246271 - RNA, 68 nt, Salmonella enterica enterica serovar Typhi
guuaguaaccuucagacucaugguagaaucuucugucaugacuauuccgcacaacaguuugagcuaac

SEQ ID NO: 4246272 - RNA, 76 nt, Salmonella enterica enterica serovar Typhi
ugcccgguggcgcugcgcuuaccgggccuacagguacagaugcuguaggccggaugagcguuagcgccauccggca

SEQ ID NO: 4246273 - RNA, 55 nt, Salmonella enterica enterica serovar Typhi
gaaagggcagauaaaggacaaugccaucgaggcauuguuacacgauccccuuuuc

SEQ ID NO: 4246274 - RNA, 69 nt, Salmonella enterica enterica serovar Typhi
auggaaaaggauaauaauguauuuagccguaagaauauuuggcuggaaauacuaucauucucauaccau

SEQ ID NO: 4246275 - RNA, 71 nt, Salmonella enterica enterica serovar Typhi
cacuacgccgacagauucaggcggugaaggugacgggcagacaauucgugaaucuugauccugacguggug

SEQ ID NO: 4246276 - RNA, 110 nt, Salmonella enterica enterica serovar Typhi
caucauccgcgcgcugggcagaauuaucaaaaacggucaucugcacaaaggcgcuaagccggugcacugguguguugacugucguuccgcgcuggcggaagcggaaguug

SEQ ID NO: 4246277 - RNA, 124 nt, Salmonella enterica enterica serovar Typhi
cgauccugacguaccaguucggacaggaugcuuuucagcgcgccgcgguacaucuucuuguuaacuuuuugacugugguccugcggacgagcagcgaaggucacgccaccggaacgccagaucg

SEQ ID NO: 4246278 - RNA, 80 nt, Salmonella enterica enterica serovar Typhi
ggaacggcuugucaaucgcacgcucugguuccgggauguaagaauccaggaagccagccaguucgaugauuuucgcuucc

SEQ ID NO: 4246279 - RNA, 65 nt, Salmonella enterica enterica serovar Typhi
gccugcgucuggacguggugaaccugaucgccaaagaucaggauuuuccugacgauccgacgggc

SEQ ID NO: 4246280 - RNA, 55 nt, Salmonella enterica enterica serovar Typhi
cgcgcggaugauggcgucggccgggguguucgccuggcugcuguucaucugcgug

SEQ ID NO: 4246281 - RNA, 57 nt, Salmonella enterica enterica serovar Typhi
agccgcguugaagccuaucccuccgaaccgccguuugauggcguuaucagccgcgcu

SEQ ID NO: 4246282 - RNA, 71 nt, Salmonella enterica enterica serovar Typhi
augaugcacaucggcauccauucaccgucugcgcaauacuucgcuaucgcuaugcugcugauguucaucau

SEQ ID NO: 4246283 - RNA, 84 nt, Salmonella enterica enterica serovar Typhi
ugccgagccuccagcaguuuaauaagguucuggcuuacgaaguccguaugcugaugaccgauaagcugcaacuggaggacggca

SEQ ID NO: 4246284 - RNA, 67 nt, Salmonella enterica enterica serovar Typhi
uacccgccagcggaccgggaaagucagcgauugaauccggaaugacuuucaggccgcuggccuggua

SEQ ID NO: 4246285 - RNA, 75 nt, Salmonella enterica enterica serovar Typhi
cgccaucauggagcugaaugcaccaucaccgaucugaacuacgaugaugcagugcgacuggcccauagaauggcg

SEQ ID NO: 4246286 - RNA, 61 nt, Salmonella enterica enterica serovar Typhi
gauaacgguagguaucaaucgccuuacgaauaucaggacgaucaaucaauuuaccguuauu

SEQ ID NO: 4246287 - RNA, 64 nt, Salmonella enterica enterica serovar Typhi
cccugggggaagaaaccgcguuccugugcgaaguucagcaggccgguauuuucuccaucagcgg

SEQ ID NO: 4246288 - RNA, 59 nt, Salmonella enterica enterica serovar Typhi
ccugauaagcgccgucuacaaaaaagccccucgugaagaggggcuuaauggcuaucggg

SEQ ID NO: 4246289 - RNA, 127 nt, Salmonella enterica enterica serovar Typhi
aaaacguugcuggcgcgcguacugcccguggcggaggugauucaacgcugcagcgaacugggguucggcguuggagaaauuuucgcacugugugggccguucagcgcugauuuuaacgccgcguuuu

SEQ ID NO: 4246290 - RNA, 72 nt, Salmonella enterica enterica serovar Typhi
uccgggucgaggaucgccauauccggauacagcgcauuguugaacagcggauacuugaugccuuuauccgga

SEQ ID NO: 4246291 - RNA, 63 nt, Salmonella enterica enterica serovar Typhi
uuuccauggucgcggcgauuuuaucaagcggcaucccugaaaaaagccccgcgcccauugaga

SEQ ID NO: 4246292 - RNA, 90 nt, Salmonella enterica enterica serovar Typhi
gcgcuugagaucaacaaaaacaugcuguuguggaucaacgaugcgcugauggccguguuuuuccuguugauuggccuggaaguuaagcgc

SEQ ID NO: 4246293 - RNA, 97 nt, Salmonella enterica enterica serovar Typhi
gaauauggggcugcugggcgcucugucugcggacgucacccgcucagaugcgcgguugccgcacgggcagaagcaguccgguuacagcuaccguauc

SEQ ID NO: 4246294 - RNA, 62 nt, Salmonella enterica enterica serovar Typhi
gcggcuguaugacgcggugcaaucggaguuguccaugaugguuccaacguccauacagcagc

SEQ ID NO: 4246295 - RNA, 99 nt, Salmonella enterica enterica serovar Typhi
gccccagcucuuuugcccgauaauauuuaccgauuaauagccccgcaaggugguggucgcggaaauuaugggaaauaaaaucgaguacuuuuugguggc

SEQ ID NO: 4246296 - RNA, 103 nt, Salmonella enterica enterica serovar Typhi
gccauaaauccucaugucguguuugcaacgguuccgguaguaccgguuauuguuauggguacaucgauuguugcgaauauuuucuuaaauuuggacaaauggc

SEQ ID NO: 4246297 - RNA, 84 nt, Salmonella enterica enterica serovar Typhi
gcggcgugccaccaugauaccuuguucugacagcagagagguuaacuugcugucgcucagugguuucgcgggguuuuccgccgc

SEQ ID NO: 4246298 - RNA, 69 nt, Salmonella enterica enterica serovar Typhi
ccugaccuuugcugaacaguugccgggcgaucuggacauucgcuuugucccgcuuucggcguuggaagg

SEQ ID NO: 4246299 - RNA, 57 nt, Salmonella enterica enterica serovar Typhi
cagaaccuggcucaucagugauuuuauuugucauaaucauugcugagacaggcucug

SEQ ID NO: 4246300 - RNA, 65 nt, Salmonella enterica enterica serovar Typhi
caggcgcgggcguuacugauaauggccugaauuuuaccgcgaugucguaugaugcccguguucug

SEQ ID NO: 4246301 - RNA, 57 nt, Salmonella enterica enterica serovar Typhi
aggugaggcauuuucgccagauccgccacuaccggaucgcccgcgauauccuuaccu

SEQ ID NO: 4246302 - RNA, 97 nt, Salmonella enterica enterica serovar Typhi
gcuggauacgcuggcgcuguacuuggcaugugguauugauccugaaaagagcacuauuuucguucagucccaugugccggaacaugcgcagcuuggc

SEQ ID NO: 4246303 - RNA, 71 nt, Salmonella enterica enterica serovar Typhi
gcaauagcgacaggaaucugugugaggcagaaaauccccauaaacuucacaacagacccugucgcuccggc

SEQ ID NO: 4246304 - RNA, 124 nt, Salmonella enterica enterica serovar Typhi
ggcgcuucaacgggcgguacugaagcuauccgacaugugcugcaaccgcugccgcuuuccaguccggcagugauuauuacgcagcauaugccgccuggcuuuacccgcucguuugccgagcgcc

SEQ ID NO: 4246305 - RNA, 67 nt, Salmonella enterica enterica serovar Typhi
acaugauucgguacuggcuggaaaguaauacaguuguccaccgacccgcccggcaucggauucaugu

SEQ ID NO: 4246306 - RNA, 77 nt, Salmonella enterica enterica serovar Typhi
gccuauccguaauauggugaauaccguugaccgcauucgccgcggacaacuggauagccguguggaaggauuuaugc

SEQ ID NO: 4246307 - RNA, 61 nt, Salmonella enterica enterica serovar Typhi
aacagcauaggagcgguugauucaugaaaaucaggcaugagcacaucgaaucaguguuguu

SEQ ID NO: 4246308 - RNA, 78 nt, Salmonella enterica enterica serovar Typhi
guguaguagugugaugcgaucguauguacagaugagaaaaaaacucugaauaacgauauuucauccccauuacugaac

SEQ ID NO: 4246309 - RNA, 56 nt, Salmonella enterica enterica serovar Typhi
aaaguguaauguucuaacaggucucuucuaggagcuggcguaacgcauuauacuuu

SEQ ID NO: 4246310 - RNA, 87 nt, Salmonella enterica enterica serovar Typhi
uggucuuaccgccuguugcuuguugugauugaauaaaaucauaacgauuauauucaaucaaauuaagaucacaaacgcgucagauca

SEQ ID NO: 4246311 - RNA, 64 nt, Salmonella enterica enterica serovar Typhi
guacuuucacuacugccagaauucuuauagucacuguaauacuggcuggcauaguaagaaguau

SEQ ID NO: 4246312 - RNA, 74 nt, Salmonella enterica enterica serovar Typhi
gacggugccugucgguacggcgcgccugcgcuuaacguuaacgcaggcgcaugaagcgugcgauauagaccguc

SEQ ID NO: 4246313 - RNA, 56 nt, Salmonella enterica enterica serovar Typhi
auccgaaauccgucuguaucucuauuaaugaaguggugugccacggcauuccggau

SEQ ID NO: 4246314 - RNA, 69 nt, Salmonella enterica enterica serovar Typhi
gaugauggcaaugguauuccuaaagggccgcuugcgccuuugcuuauugggauacugguugccguuauc

SEQ ID NO: 4246315 - RNA, 55 nt, Salmonella enterica enterica serovar Typhi
agcgccccguuucgguccuggugguuauuuucgcgcaggauacgaaacgggugcu

SEQ ID NO: 4246316 - RNA, 59 nt, Salmonella enterica enterica serovar Typhi
gagugcgggcuggauauggaauuacagcgcaccucccgcggcuuucaccauccgcauuc

SEQ ID NO: 4246317 - RNA, 57 nt, Salmonella enterica enterica serovar Typhi
cuggaguuuauagauuugcccccaguccagacgggaagcgagaucggguaagcccag

SEQ ID NO: 4246318 - RNA, 56 nt, Salmonella enterica enterica serovar Typhi
cgaguaauccucugaaacuucgggccuuuuaguccgaaguauaacgagauuacuug

SEQ ID NO: 4246319 - RNA, 61 nt, Salmonella enterica enterica serovar Typhi
cgccgcgccguuuaacggccuuuuagccgaacagcuugaggcgcgguuaaccggcgcuacg

SEQ ID NO: 4246320 - RNA, 130 nt, Salmonella enterica enterica serovar Typhi
gccuucgagcgcaaucggauauugaucgccacgaccgaggaauaacgcgugaugcuugucagagaaaucuucugcaagcagcucgaugcguuuguccugcgacagcaucugcucaauacggcucggcagc

SEQ ID NO: 4246321 - RNA, 73 nt, Salmonella enterica enterica serovar Typhi
gguauuguuuggcaaugaggcuacauuaguuugggaauaauuaacaucaagcccauugucuuuacaauauucc

SEQ ID NO: 4246322 - RNA, 55 nt, Salmonella enterica enterica serovar Typhi
gccguaacgugcuugcugacguucgcggaagaacucuucauaggucauguacggc

SEQ ID NO: 4246323 - RNA, 56 nt, Salmonella enterica enterica serovar Typhi
uugacuuugggucugcgcgucgcguccguccgggcaguaccaguaaccaaagucga

SEQ ID NO: 4246324 - RNA, 90 nt, Salmonella enterica enterica serovar Typhi
guuggcguacuggauauuccaggcuucuauguuggcuugaccgaugaugucaaaguucagcuucagaagcuggaaaaacagaauguuaac

SEQ ID NO: 4246325 - RNA, 66 nt, Salmonella enterica enterica serovar Typhi
cggugcguggccucgcccagccgcaccugcuccagcaacuguugcugcgcggaggucgcugcgccg

SEQ ID NO: 4246326 - RNA, 55 nt, Salmonella enterica enterica serovar Typhi
cauuuuagacuugugcgccgcgcccggcgguaaaaccacgcauauucucgaagug

SEQ ID NO: 4246327 - RNA, 58 nt, Salmonella enterica enterica serovar Typhi
gaauaugcagaugaggaaaaugcugcugacacagcgccaccagcuucaucgugucuuc

SEQ ID NO: 4246328 - RNA, 82 nt, Salmonella enterica enterica serovar Typhi
cgggaugcuucuucgcccaacguuugcggcgccuggcgcauuugcguaaugaucgccugcugaauuugggcgaacucuuccg

SEQ ID NO: 4246329 - RNA, 73 nt, Salmonella enterica enterica serovar Typhi
uaggcgaugugguucgcuuugagcuggauuauacgggccuguuaauggccugccagaccaaaggcgucgccug

SEQ ID NO: 4246330 - RNA, 105 nt, Salmonella enterica enterica serovar Typhi
gauggcguccagcuuaccguguauggaggcgauagcaugcccgucguuacguucguuggcgucguuaagcugcgccuccagaugccgguauucacggucgccguc

SEQ ID NO: 4246331 - RNA, 56 nt, Salmonella enterica enterica serovar Typhi
gauggucaaacuggcggagacgaaccaguuaguuugucauuuccgguuugacgauc

SEQ ID NO: 4246332 - RNA, 63 nt, Salmonella enterica enterica serovar Typhi
aucaguuucaggaugaagaccgucgacguuuugucguuaaguuuuaucguccugaacgcuggu

SEQ ID NO: 4246333 - RNA, 58 nt, Salmonella enterica enterica serovar Typhi
cagcgucagaaauaacugaagaguauaggugguuuuuucagccguuuucaggacgcug

SEQ ID NO: 4246334 - RNA, 58 nt, Salmonella enterica enterica serovar Typhi
ggggcuggagcucacgauuccgguggauaaaaccuggaaucgccacgaucucuaucuc

SEQ ID NO: 4246335 - RNA, 58 nt, Salmonella enterica enterica serovar Typhi
augcguagaauauccgcgcuggucauuuuguccguaauaccgcgcggguuuucgccau

SEQ ID NO: 4246336 - RNA, 64 nt, Salmonella enterica enterica serovar Typhi
gaaacgcaucgguaugauugcgccagaagcuguggcuuugcguaucaucaacccgaugcgcuuc

SEQ ID NO: 4246337 - RNA, 95 nt, Salmonella enterica enterica serovar Typhi
uaauuugauggaucucauuacacuuaaguuggaugauuuauugauugcacauaaagaucuuguccuccuuacgucugucgauguccgucgauuua

SEQ ID NO: 4246338 - RNA, 64 nt, Salmonella enterica enterica serovar Typhi
gcugauuacccgggagcaauguuguggauuuuuuauucauacagggcggacggguaguaagagc

SEQ ID NO: 4246339 - RNA, 72 nt, Salmonella enterica enterica serovar Typhi
aucauguuuacucuacuggccguaggcgcgcuguucggcgcguuauucauauggcuauuaggguagacgggu

SEQ ID NO: 4246340 - RNA, 69 nt, Salmonella enterica enterica serovar Typhi
gagaagcuggcgcaguuggaauuccgccggauguucuccggcgaguacgauagcgccgauugcuaucuc

SEQ ID NO: 4246341 - RNA, 70 nt, Salmonella enterica enterica serovar Typhi
ugaccucugaaggacgcgugaucggugcugaacgcagcgaaaugcagaucauucguaacuucauugguca

SEQ ID NO: 4246342 - RNA, 82 nt, Salmonella enterica enterica serovar Typhi
gggccaggacccggaaguacgcuauaugccgaguggcggugcugucgccaacuuaacgcuggcuacuucugaauccuggcgc

SEQ ID NO: 4246343 - RNA, 64 nt, Salmonella enterica enterica serovar Typhi
gaacuggcgcaaugguuaggauauccacgcgcgcugcuguuuaucucuggcuuugcggcgaauc

SEQ ID NO: 4246344 - RNA, 80 nt, Salmonella enterica enterica serovar Typhi
ucuggcaaagaaucauuuuugauccguuaucguauauccauccucagcgguugcagauagcgccggaaaugauugucaga

SEQ ID NO: 4246345 - RNA, 73 nt, Salmonella enterica enterica serovar Typhi
auaccuuuuauacgucgaaugacaaaggcgcuguauggucaggcgucugucauucgacgaaugauuaagguau

SEQ ID NO: 4246346 - RNA, 83 nt, Salmonella enterica enterica serovar Typhi
gguagcgcagacgcucgccggguuuuucgcgaaaaccaugaccgccggccaugucgcuaaagcccggcaccaugcagcuugcc

SEQ ID NO: 4246347 - RNA, 66 nt, Salmonella enterica enterica serovar Typhi
cagggcgcuggagagugaccugcagcagucggcgaaacguugcaggauggcguccagcgaccacug

SEQ ID NO: 4246348 - RNA, 94 nt, Salmonella enterica enterica serovar Typhi
ccgcacgaucugaccgucccuuacggcgaccguggcggcguaguuaucgaaccgaugcugaccgaccagugguacguccgugcagacgugcugg

SEQ ID NO: 4246349 - RNA, 93 nt, Salmonella enterica enterica serovar Typhi
guuccggcguuucggcgacauucagcgcgugcuguuuuggcguccagaccuucuuacaguacuggcacugaagucgcugcguuccgccgggau

SEQ ID NO: 4246350 - RNA, 64 nt, Salmonella enterica enterica serovar Typhi
cagcagcaacaucaggcccuguaaagccaggauccugacuccaguuggcugauguuguauucug

SEQ ID NO: 4246351 - RNA, 65 nt, Salmonella enterica enterica serovar Typhi
uccuucaacuggcagaagaaucuggacgacaagaccauugccagcuuccagcagcaguugucgga

SEQ ID NO: 4246352 - RNA, 128 nt, Salmonella enterica enterica serovar Typhi
gccuucuccuuuuguuaccgccagugcaaaaacauuugacgcugaaguugcugccgcauuuacguuuuucccggaugccgggcggcggguuuagcgcggguacuggcgguggcgaaacauuugacggc

SEQ ID NO: 4246353 - RNA, 129 nt, Salmonella enterica enterica serovar Typhi
uccgcuuuggugcuagccgcgcgggcgauuucuuguuauuacagaaggcgggggcggaguaugguuuugcgguuuccagcacccaaaccuuuugugaaggcggcgugcguaucaguaguaccgcaguga

SEQ ID NO: 4246354 - RNA, 80 nt, Salmonella enterica enterica serovar Typhi
cggccaaaauaauauuuuccgcuuccagcgucaguucuccugaguggcguacaugguggaaggucacuuuauuuccgcug

SEQ ID NO: 4246355 - RNA, 60 nt, Salmonella enterica enterica serovar Typhi
caggaaucacaggcggcuuaucugcugcguaagcaugaagugagccgucuggauaucgug

SEQ ID NO: 4246356 - RNA, 72 nt, Salmonella enterica enterica serovar Typhi
guugaugcuggcaagauggaagguacguacaagcguaagccugagcguucugaucugucugcggacauuaac

SEQ ID NO: 4246357 - RNA, 71 nt, Salmonella enterica enterica serovar Typhi
ccggcgaugcgguucaucaacguuaugugguugauaccaaaggggucuggcgcugaugaaacgcauucugg

SEQ ID NO: 4246358 - RNA, 60 nt, Salmonella enterica enterica serovar Typhi
ggcggcggauaucgaaguggaucuggcgaaguuugccggucucccgauguaccgcacguc

SEQ ID NO: 4246359 - RNA, 63 nt, Salmonella enterica enterica serovar Typhi
ucggggguguugguagugcagcugcgguagaaaagggacgcggucugcaaacaauucccccgg

SEQ ID NO: 4246360 - RNA, 89 nt, Salmonella enterica enterica serovar Typhi
cuggccugcgcugccgucggcguucgugccaaccacguagccguucagguuguuggacgcgccggacgugucgccggcggcgaagccgg

SEQ ID NO: 4246361 - RNA, 67 nt, Salmonella enterica enterica serovar Typhi
ccagugacgauuauuacugacauuuauggcgacgacguaaaauacaccgguaaagucgucggucugg

SEQ ID NO: 4246362 - RNA, 82 nt, Salmonella enterica enterica serovar Typhi
gcgaguaauaggccaguacguucgaaucgcugccacaacacacaaagguacgggacgcgccaguggucugauuuuucaucgc

SEQ ID NO: 4246363 - RNA, 58 nt, Salmonella enterica enterica serovar Typhi
aaucguuggggauaaucuggugcugaucgcgcucaguaccgcgguggucacggcgauu

SEQ ID NO: 4246364 - RNA, 127 nt, Salmonella enterica enterica serovar Typhi
gccagaaauccgccgcuuuuucauucggcauggcgauuucauagcccgcuucgccgguauaaccggugguggcgauaaacagaucgcccgccugaacgccgaagaacggcuucauaccuucuacugc

SEQ ID NO: 4246365 - RNA, 74 nt, Salmonella enterica enterica serovar Typhi
ugggucgugcaggaugacucggcuucgccucgcccuacgggccguugcugacgcaacguuauccuucacguuca

SEQ ID NO: 4246366 - RNA, 67 nt, Salmonella enterica enterica serovar Typhi
ggacaauguugauuaucaggggcgucugguguuaauucaguaucggccuaaaugaucggcaucguuc

SEQ ID NO: 4246367 - RNA, 61 nt, Salmonella enterica enterica serovar Typhi
uccugcgauagcugcugacguagauucugauugagcauaucgacggucaggcuguugagga

SEQ ID NO: 4246368 - RNA, 57 nt, Salmonella enterica enterica serovar Typhi
ucggcagcgaaaaauucacugcuucgacauucacgguuuggugauuaauccugucga

SEQ ID NO: 4246369 - RNA, 56 nt, Salmonella enterica enterica serovar Typhi
cuuuauggugcgccauauucucgacugggccgaagggcaucagcguauccgugaag

SEQ ID NO: 4246370 - RNA, 67 nt, Salmonella enterica enterica serovar Typhi
gcgccgcucacgucauacaucggcccuugaauaauauguuugccgucgucagugacguacaguacgc

SEQ ID NO: 4246371 - RNA, 69 nt, Salmonella enterica enterica serovar Typhi
ggcgucagcgguuccgcggcggucauggcauugauccuuuugcccuucucgccgcagccagcucacgcc

SEQ ID NO: 4246372 - RNA, 60 nt, Salmonella enterica enterica serovar Typhi
guucguggugaaaauuacgcagcccaucaucggaccgcugcgucguauuaucccgccaau

SEQ ID NO: 4246373 - RNA, 80 nt, Salmonella enterica enterica serovar Typhi
uguaacggcucuauuugcgcacgcagaucauccggcaucggaggacgaugcgauuuguaguguucaaagagcucgucacg

SEQ ID NO: 4246374 - RNA, 129 nt, Salmonella enterica enterica serovar Typhi
ucguccaugcggauuuaaccgaacuggucuccucgcaggcuaaagugaugcuugccgggaucgacacguuguggcacugcuccagcuuuaccucgcccuggggaacccaacaggcuuucgaucuggcga

SEQ ID NO: 4246375 - RNA, 60 nt, Salmonella enterica enterica serovar Typhi
auaugcguauuuucuggcggagggaugucgcuccuuaucucgccaaagaaaaacgccugu

SEQ ID NO: 4246376 - RNA, 100 nt, Salmonella enterica enterica serovar Typhi
auuucugcaacauggcgaaagagcuggcuuuucuugggauucaggccgcgccaccggaagcgguacugguauccagaaacuaucucacagccguagagau

SEQ ID NO: 4246377 - RNA, 69 nt, Salmonella enterica enterica serovar Typhi
uugucagggugauacuggcguugcagauccugaaaacgaaagcucagcgccugggugucaaucugauaa

SEQ ID NO: 4246378 - RNA, 61 nt, Salmonella enterica enterica serovar Typhi
gccuggcaaagaaucguacaugcggcugaaugaaaaagcgcuggaugauuuuugucagagc

SEQ ID NO: 4246379 - RNA, 65 nt, Salmonella enterica enterica serovar Typhi
uugaguuuguuggcuggaugaacgacugccggauggcgcagugcuuauccggccuacaaacccaa

SEQ ID NO: 4246380 - RNA, 71 nt, Salmonella enterica enterica serovar Typhi
uguaugucuguacguuuccauuugaguauccugaaaacgggcuuuucagcaugguacguacauauuaaaua

SEQ ID NO: 4246381 - RNA, 60 nt, Salmonella enterica enterica serovar Typhi
acuccuguuaaacccgcuaacgguucauuacgaacgcuaugauaacggguuaacaggcgu

SEQ ID NO: 4246382 - RNA, 80 nt, Salmonella enterica enterica serovar Typhi
gucggguggcgcuagcgcuuacccgaccgacaaaaucaagcagacgauguaggucggguaaggcguagccgccacccggc

SEQ ID NO: 4246383 - RNA, 93 nt, Salmonella enterica enterica serovar Typhi
gaucacgguaugaugcugcugauauuuuccgccuuuaugcugcguuauuucggcaaaacggcggggauuaucgcccuuauuauauuugugguu

SEQ ID NO: 4246384 - RNA, 61 nt, Salmonella enterica enterica serovar Typhi
ggucauguggguggacgcgguaaccaucgaacagaucgccgacgcgcuccgccaacuggcc

SEQ ID NO: 4246385 - RNA, 129 nt, Salmonella enterica enterica serovar Typhi
ugccggugguguuggcggugauacugucaacggcauaggugugguccugggaaaucgccaacguauagccagugaggacgcuaaugccgcuggcgguauucagcacgaacaaguauucgccgccaggca

SEQ ID NO: 4246386 - RNA, 79 nt, Salmonella enterica enterica serovar Typhi
gcgccauuucugccaaugagcgcaaacugguaaacgguuaugcaaaguuucucgcugcauauggcgggaaugaaagcgc

SEQ ID NO: 4246387 - RNA, 68 nt, Salmonella enterica enterica serovar Typhi
cgguuuccgccgccaguuuggggcggucaaaaguguagcuugcgccguccaccguggcgguggaacug

SEQ ID NO: 4246388 - RNA, 79 nt, Salmonella enterica enterica serovar Typhi
gaagguuacuaacacuggcagucugaguguuaaucaguauggauggauuaacaucuggacggcuauuuuaggucacuuc

SEQ ID NO: 4246389 - RNA, 80 nt, Salmonella enterica enterica serovar Typhi
gccugauggcgcugcgcuuauccggucuacguaaugcauagcgucuguaggccggauaaggcguuucgccgccauccggc

SEQ ID NO: 4246390 - RNA, 76 nt, Salmonella enterica enterica serovar Typhi
caccauccugccgcguaugaagagcggugagcgcgugaucaucgccgcucacgguaacucauugcgugcgcuggug

SEQ ID NO: 4246391 - RNA, 63 nt, Salmonella enterica enterica serovar Typhi
gacgcaauucuggcuggugacgcccaaagccucgcuggcgggcguuuccggccuggaugcguu

SEQ ID NO: 4246392 - RNA, 80 nt, Salmonella enterica enterica serovar Typhi
ugccggguggcgcugugcuuacccggccuacaaaaucacgauauacgcuguaggcccgguaagcgaagcgccaccgggcg

SEQ ID NO: 4246393 - RNA, 59 nt, Salmonella enterica enterica serovar Typhi
uucuaacaaaacuaauguugagaauggauacaaacuucugaacauucagauuguuggaa

SEQ ID NO: 4246394 - RNA, 64 nt, Salmonella enterica enterica serovar Typhi
cagggacuccguuggcucaacgucggcauacagugccaucuugcccgccagcggaccuuccgug

SEQ ID NO: 4246395 - RNA, 92 nt, Salmonella enterica enterica serovar Typhi
acgcguuuuuggcucaggaagucacgcugccagcgaucugggaacacgaucgcucucaggaugauuaugucgacggguuaacaaaagugcgu

SEQ ID NO: 4246396 - RNA, 84 nt, Salmonella enterica enterica serovar Typhi
gucggcauuguggggcuuggcucaaugggaaugggcgcugcgcguucaugccugcgcgccgggcuuuccacauggggggccgau

SEQ ID NO: 4246397 - RNA, 87 nt, Salmonella enterica enterica serovar Typhi
ggcgggcaugucgauuuugcgccuaauagcgaagaagaagcuaugauucuggaaauauugcgcgccgaaauuggccacguuuccgcc

SEQ ID NO: 4246398 - RNA, 77 nt, Salmonella enterica enterica serovar Typhi
ucugauggcggcguaacgucuuaucuggccuacgugagcggugccgucuguaggccugauaagcgcagcgcaucagg

SEQ ID NO: 4246399 - RNA, 61 nt, Salmonella enterica enterica serovar Typhi
ucguggugauugauguugguguguacguuuaugaugucuuugcgcacuuuaaucgccauga

SEQ ID NO: 4246400 - RNA, 83 nt, Salmonella enterica enterica serovar Typhi
cgcuggaucgaucuuugcucuggcacacucccuaaugcaaaggauccugcauuucugaaagucagagcacauauuuuccagcg

SEQ ID NO: 4246401 - RNA, 60 nt, Salmonella enterica enterica serovar Typhi
gcagcgguauugacgugauggcugucaauaaaguuuuugacggcugcguggaaaccgcgc

SEQ ID NO: 4246402 - RNA, 60 nt, Salmonella enterica enterica serovar Typhi
ugccggagaugaccgauguucaccugccgcucaaucugaauaucgagucauuucgcggcg

SEQ ID NO: 4246403 - RNA, 65 nt, Salmonella enterica enterica serovar Typhi
cguugucacguggcgauucgaaaaaucgggcagguacggugguaacggauggcgacguggcagcg

SEQ ID NO: 4246404 - RNA, 126 nt, Salmonella enterica enterica serovar Typhi
ggagcgucguuaacgcuguagugccggauggcggcgaaaugccuuauccggccuacucuugagccggauguaggccugauaagcguagcgccaucaggcauaaaccuaucaggcguugaccgcuuc

SEQ ID NO: 4246405 - RNA, 60 nt, Salmonella enterica enterica serovar Typhi
cgauuuuuaacgccgguuuacgcccggccuuaucgaccguaaagacggcgauaaaagucg

SEQ ID NO: 4246406 - RNA, 79 nt, Salmonella enterica enterica serovar Typhi
uuuugccaacuuuagcgcauuuuuucggcgcuaucugcugacucgauucacguccgaaaaaguguuagaucggucaaaa

SEQ ID NO: 4246407 - RNA, 80 nt, Salmonella enterica enterica serovar Typhi
cggcguuucagguuguugggauguuucagauugcccauuauagugcuggacaccgacgauaacugcaagugaaacgcacg

SEQ ID NO: 4246408 - RNA, 70 nt, Salmonella enterica enterica serovar Typhi
gguuuucauuguuguggaaccgcuucgacgcuggaaaaagcgaaagaguuuaucuucaacagugaaaauc

SEQ ID NO: 4246409 - RNA, 84 nt, Salmonella enterica enterica serovar Typhi
guggcugaucgccgccuucaucgucgggcacguuuaccucgcuauccgggaagacauuauguccgacgauacggugaucuccac

SEQ ID NO: 4246410 - RNA, 59 nt, Salmonella enterica enterica serovar Typhi
uucugcugccgcugacgcuggccauccucgaugggaugucgguucgcguggcgggggaa

SEQ ID NO: 4246411 - RNA, 59 nt, Salmonella enterica enterica serovar Typhi
ggggggauuacccgucgcauucaucugcuucacaaacugaaugacgggcugguugaccc

SEQ ID NO: 4246412 - RNA, 58 nt, Salmonella enterica enterica serovar Typhi
acuggcggauuagcgaaggcacgcaaagccccgaccugccgaugcaaaugcugccagu

SEQ ID NO: 4246413 - RNA, 75 nt, Salmonella enterica enterica serovar Typhi
gcugguggguauggacagcaagcuuuccggcauccuggauaugcuggaagaagccacuauccaacucaccgaagc

SEQ ID NO: 4246414 - RNA, 82 nt, Salmonella enterica enterica serovar Typhi
augucaccggugggcguuuguaugcacauagccuggaacgcaucauucccggcuuugcggaucaggcccccauugaacgcau

SEQ ID NO: 4246415 - RNA, 83 nt, Salmonella enterica enterica serovar Typhi
gcacgcugcaaaaugcguuucacgccauuuugggcauuggccccaaugcguggcugaaacguauucgccucaaugcagugcgc

SEQ ID NO: 4246416 - RNA, 59 nt, Salmonella enterica enterica serovar Typhi
gguaaauggguaauaaguauugauggcgaaguaacgauccgugacauuacucguuuacc

SEQ ID NO: 4246417 - RNA, 80 nt, Salmonella enterica enterica serovar Typhi
cauucuggcggaaaucgcagguaucguuuccuucgguaaagaaaccaaaggcaaacgucgccuagugauuacgccgguug

SEQ ID NO: 4246418 - RNA, 61 nt, Salmonella enterica enterica serovar Typhi
uuugcgcugguguauugguuuuuguuggugcgauggaugaccguuuugauaucaguguaaa

SEQ ID NO: 4246419 - RNA, 59 nt, Salmonella enterica enterica serovar Typhi
acauaucguaaugcgggcgauaccacuccagcauggugaauuccggauuaugaugucgu

SEQ ID NO: 4246420 - RNA, 122 nt, Salmonella enterica enterica serovar Typhi
agcccgcugcaaggccgcgccaacgugaugauuuucccgucgcuggaggcgggcaauauuggcuacaaaaucgcucagcgucugggaggcuaucgcgcuguugggccgcuaauucaggggcu

SEQ ID NO: 4246421 - RNA, 92 nt, Salmonella enterica enterica serovar Typhi
aauaguguaaacgcgugaguguaccauuuccacguagcauuuuaauagcugcgaugcagguuccaggucacucgcgcgaaccucauauuguu

SEQ ID NO: 4246422 - RNA, 69 nt, Salmonella enterica enterica serovar Typhi
gcugauguguucugggaucugcaggacccggcaaccgaugcgggacugcugaaccagaacgacgucacc

SEQ ID NO: 4246423 - RNA, 76 nt, Salmonella enterica enterica serovar Typhi
uucaccgacaucccucgggcguaguuugcgccgccgcccgcuggcgcguaaaaaacugucugaaaugguugaggaa

SEQ ID NO: 4246424 - RNA, 58 nt, Salmonella enterica enterica serovar Typhi
uaccgucggugauaucgaaucgcugccguuucuugaggcgauucgucaauuggcggua

SEQ ID NO: 4246425 - RNA, 71 nt, Salmonella enterica enterica serovar Typhi
gcguacugauuucgcuggaucgucaggaacguggccgcggcgagauuuccgcgauucaggaaguggagcgc

SEQ ID NO: 4246426 - RNA, 63 nt, Salmonella enterica enterica serovar Typhi
gaucagcgugcuauuuuuuucgcguaacaucucguccagcgaacgaaggaaaggcugcugauu

SEQ ID NO: 4246427 - RNA, 56 nt, Salmonella enterica enterica serovar Typhi
gaccggaaauagucggcauacgcggaucaucccaaccuucgacguguuugucgguc

SEQ ID NO: 4246428 - RNA, 68 nt, Salmonella enterica enterica serovar Typhi
augccgauagcuaacagcaggaaccccggcagaucaaagcgccgggucucuaugguguaguuuggcau

SEQ ID NO: 4246429 - RNA, 67 nt, Salmonella enterica enterica serovar Typhi
gcgucgcagcuuucauggcguaugaauccauuaaguauccauguacgccauaagccuugcugacugc

SEQ ID NO: 4246430 - RNA, 129 nt, Salmonella enterica enterica serovar Typhi
auucugcuguuguuggccgguuuucuggcaaucaaaaucgucaugcuguggcuggucgcgaggacccugggcguaccggcaaaacagcgucgcugguuugccgucuuauuaggccagggaagugaguuu

SEQ ID NO: 4246431 - RNA, 56 nt, Salmonella enterica enterica serovar Typhi
gcauuaugcgcugguggaugagguugacuccauccugaucgaugaagcgcguacgc

SEQ ID NO: 4246432 - RNA, 69 nt, Salmonella enterica enterica serovar Typhi
guuggucaaaucuacuauuucacggagucucgcaccggcgaugacaacauuaaaugggagaaugacgac

SEQ ID NO: 4246433 - RNA, 76 nt, Salmonella enterica enterica serovar Typhi
gaguauuuauugugcauagagguaagaaugugacaacgauccguugcauucucgucugucaugcacaucaacacuu

SEQ ID NO: 4246434 - RNA, 73 nt, Salmonella enterica enterica serovar Typhi
ucacuauugauacuacguugucgacgccgguuaucguacuggauagcgcggacgacagugguguccauggcga

SEQ ID NO: 4246435 - RNA, 64 nt, Salmonella enterica enterica serovar Typhi
auauuaacgucagcgauaugaguaacguggacgaacaauaucugaauaccguuggccuugaugu

SEQ ID NO: 4246436 - RNA, 57 nt, Salmonella enterica enterica serovar Typhi
guccgcaggcguucgaaaaggguaaacaaguacaacccuuuuccuacguuugcagau

SEQ ID NO: 4246437 - RNA, 130 nt, Salmonella enterica enterica serovar Typhi
gguauaaggcuaucuuguuugccauuuuagccccggggugugcucgaaaugcucacguacugcguguacgcuccgcuuucugcgcgcacgccggagcuaaacuggcugcaccgauauacgccuuuuaucc

SEQ ID NO: 4246438 - RNA, 75 nt, Salmonella enterica enterica serovar Typhi
gacuacguuaaaccacuggcagugcgucugauacugcaacucguuauuguuguugcgcuggugguuuacgucauc

SEQ ID NO: 4246439 - RNA, 73 nt, Salmonella enterica enterica serovar Typhi
aacaguaguggugguuuuacacaguuaucccaacuuucuguggauaacauaguguaagauccuguuuauuguu

SEQ ID NO: 4246440 - RNA, 85 nt, Salmonella enterica enterica serovar Typhi
gaugcgcauguguugaucacugaccucuccaugccgggagauaaauacggcgaugggaucaccuugaucaaguacaucaagcguc

SEQ ID NO: 4246441 - RNA, 55 nt, Salmonella enterica enterica serovar Typhi
guuggaacgguuaaacugaugaauauccacguccacggggugaucgauuuccagc

SEQ ID NO: 4246442 - RNA, 64 nt, Salmonella enterica enterica serovar Typhi
gagauugaauaacaucugucugggcagcuuuacuuuucagcucuugaucgaugaauucauuuuc

SEQ ID NO: 4246443 - RNA, 73 nt, Salmonella enterica enterica serovar Typhi
acuuucgacacgguggugaucguucuuaccuuuagucuugagaugcagagugacgcccaucguguaagagagu

SEQ ID NO: 4246444 - RNA, 67 nt, Salmonella enterica enterica serovar Typhi
guacauccuggccuggaguaauucgcugauggauaacuuuauuauggauguccagggcagcgguuau

SEQ ID NO: 4246445 - RNA, 77 nt, Salmonella enterica enterica serovar Typhi
gacgacuugauguauaucguuugcuauacauggugguugugcuauucuuguaaagcaaaugcuauacaagggguguc

SEQ ID NO: 4246446 - RNA, 86 nt, Salmonella enterica enterica serovar Typhi
cgcgcuaugccgaucagccugcguucgucaauaugggggagguaaugaccuuccguaaauuagaagaacguagucgggcauuugcg

SEQ ID NO: 4246447 - RNA, 79 nt, Salmonella enterica enterica serovar Typhi
ucacuauccgcuuaauuuacggcuuccugucggugaaaaccucgccaccagaccaguaaauuaaguaaggcuaccguga

SEQ ID NO: 4246448 - RNA, 65 nt, Salmonella enterica enterica serovar Typhi
uugagaucgauauacggcauauuuucugugcuauucaugauguacauggugccguguuucuucag

SEQ ID NO: 4246449 - RNA, 80 nt, Salmonella enterica enterica serovar Typhi
gcagggugaugaucagcgccagacgauuguccacccauacaacgucuuguuccaguugaccuuuaucguuaacgccuugc

SEQ ID NO: 4246450 - RNA, 79 nt, Salmonella enterica enterica serovar Typhi
gagcgaauugugaucgcuaaaacguuuuuauguuaacgccuuuaauaucaaagcguuguuagugauggcaauuuggcuc

SEQ ID NO: 4246451 - RNA, 129 nt, Salmonella enterica enterica serovar Typhi
uaauguuagguuaauauacaaccauuccaucgcuauugccguuuuguuuauccguugauguguaacguguuaugaacaaucagcgugaaacgggggcgcuauggaaugguugguuaagaaaucgcauua

SEQ ID NO: 4246452 - RNA, 97 nt, Salmonella enterica enterica serovar Typhi
gggauggcgcgcgcauugaacaguuugaucgcaaaggcaugguaaauaacaaauucaaccauuucauuaugaccaaacuggccgaggcgggcauccc

SEQ ID NO: 4246453 - RNA, 65 nt, Salmonella enterica enterica serovar Typhi
gcucacugcaggacaacaguaaaaucagaaacagucuguuuuuacugaugucuggcggucggagc

SEQ ID NO: 4246454 - RNA, 65 nt, Salmonella enterica enterica serovar Typhi
cggguuuggucagcugcuggugcguauguugaccaugaauuugaaucagcaacugaccgagcucg

SEQ ID NO: 4246455 - RNA, 83 nt, Salmonella enterica enterica serovar Typhi
cgauaaaagagguucaugaugcgccugcaguacggggaaguaucaucgcuaacaugcuacaggagcaugauaacccuuuuacg

SEQ ID NO: 4246456 - RNA, 56 nt, Salmonella enterica enterica serovar Typhi
caauuugcaaauggugaaaugauggugaaauagcuaucgaaggucacugcaaauug

SEQ ID NO: 4246457 - RNA, 73 nt, Salmonella enterica enterica serovar Typhi
cgccagcguguugaucucgccgucauuuaaugucgacagcgugauacguagaccgugagacggcgcgcuuacg

SEQ ID NO: 4246458 - RNA, 63 nt, Salmonella enterica enterica serovar Typhi
ccccggcgauaucguaccggacugugcggugauuaaucuuagcggucguaugcugugcccggg

SEQ ID NO: 4246459 - RNA, 81 nt, Salmonella enterica enterica serovar Typhi
cuacauuauggcgcgggggaaaagauggucgauauccucauccguaucgcguuaaucuuauucuucuccgccgugggaugg

SEQ ID NO: 4246460 - RNA, 83 nt, Salmonella enterica enterica serovar Typhi
gguggaagugcaacaguugcagacuguccagacgcccagcgucacgcagggucuccaccaguugcagcaccugcgucgccgcc

SEQ ID NO: 4246461 - RNA, 55 nt, Salmonella enterica enterica serovar Typhi
gcgagcaaaguaaggcgaauggaauaauguagcgcuugcuuuugcuuugcucugc

SEQ ID NO: 4246462 - RNA, 58 nt, Salmonella enterica enterica serovar Typhi
ggcaguugcugagcgcguugauccagcagccccagauccagcgugccguagcgcugcc

SEQ ID NO: 4246463 - RNA, 60 nt, Salmonella enterica enterica serovar Typhi
agcggcaucggccuguuuaucggcaugauggggcugaaaaacgccggcgugaucgucgcu

SEQ ID NO: 4246464 - RNA, 69 nt, Salmonella enterica enterica serovar Typhi
gugaaaaacguaucgccaucuuaugcuuuuucugccagaagagggggccagggaugguguuauuuuuac

SEQ ID NO: 4246465 - RNA, 68 nt, Salmonella enterica enterica serovar Typhi
uugcaacauagauaugagguucacuaauuuaccuguaagggaaagugaucagcguguuuuuguugcag

SEQ ID NO: 4246466 - RNA, 118 nt, Salmonella enterica enterica serovar Typhi
ggugaacaguuuuucgcgcagauccggguuguugauggcguccggcuggcugguacugagccacagcaggacuggggccaucagcagauucuggucgccgcugaaauccucgaucacc

SEQ ID NO: 4246467 - RNA, 97 nt, Salmonella enterica enterica serovar Typhi
uuuccugcucugcaagacgauauugaugccgauguggugaucauuggcgguggcuuuucaggcaucaauaccgcgcuggaacuggcggagcagggga

SEQ ID NO: 4246468 - RNA, 61 nt, Salmonella enterica enterica serovar Typhi
gaaaugguugcuuuugccccugccuggacugauauaugcggggcaguggaggaacuauuuc

SEQ ID NO: 4246469 - RNA, 79 nt, Salmonella enterica enterica serovar Typhi
acgcccucuacagagccugucucagcaaugauuaugacaaauaaaaucacugaugagccagguucuggugugaaagcgu

SEQ ID NO: 4246470 - RNA, 72 nt, Salmonella enterica enterica serovar Typhi
aucggcgagguucuuuaaugcaggugcuacgguuucaccaauacucgccaucgcauuagugaaugucccggu

SEQ ID NO: 4246471 - RNA, 67 nt, Salmonella enterica enterica serovar Typhi
gcggcaccuugcgggacagcuugucgauaucacucauggugaagucgauuuccgcuuccugcgccgc

SEQ ID NO: 4246472 - RNA, 55 nt, Salmonella enterica enterica serovar Typhi
guugagaugaugauggcgaugcagaaaaugcgcgcacgccgcacgccgucucagc

SEQ ID NO: 4246473 - RNA, 67 nt, Salmonella enterica enterica serovar Typhi
gagcaacagcgaggcaccaucauugaaauguuuaacauguucucugguggugcucucagccgugcuu

SEQ ID NO: 4246474 - RNA, 55 nt, Salmonella enterica enterica serovar Typhi
ugcaguuacugagaaaucaaaagcgauaaugaucgcucauacacucgguaaugca

SEQ ID NO: 4246475 - RNA, 60 nt, Salmonella enterica enterica serovar Typhi
ugcccgucuacgauaaaccgaugauuuacuauccguuaucggugcuaaugcuggcgggca

SEQ ID NO: 4246476 - RNA, 96 nt, Salmonella enterica enterica serovar Typhi
gugguaguuuucguucaggguggugauguaguaguaaacguucucuuguuuuucaccguacauacgcuccagaccaucaugcaugaugacagccac

SEQ ID NO: 4246477 - RNA, 58 nt, Salmonella enterica enterica serovar Typhi
caacaguauuagccacggcauuggauugguauuugguauugucggccuggugcuguug

SEQ ID NO: 4246478 - RNA, 129 nt, Salmonella enterica enterica serovar Typhi
gaaacguuuaucguugagcgcguugucgagauugugacugcgguacagcagcgcuauccccuuucacuggcggugauugccuguaauaccgccaguacggucucacuucccgcauuacgugaaaaguuu

SEQ ID NO: 4246479 - RNA, 104 nt, Salmonella enterica enterica serovar Typhi
gguaguguuuaagcgucaggcgaaguuccgggcucauauuaucaagguuauuaaaaagccagcguaaauagcccggaucgcguuuugcgacuucagauaccgcc

SEQ ID NO: 4246480 - RNA, 58 nt, Salmonella enterica enterica serovar Typhi
gggugacuauggucgcgucuaugaugcgcuguaccagacguugaccaucgguacgccu

SEQ ID NO: 4246481 - RNA, 57 nt, Salmonella enterica enterica serovar Typhi
ccgguagcaaacuggugaacgccguucaacaggacguccacgccauuuugcaacugg

SEQ ID NO: 4246482 - RNA, 108 nt, Salmonella enterica enterica serovar Typhi
ccacccguauggacccugcgcgggauacggugcugguugaaaauacgccgauugacuaccuggauuuugccucgccggucuccgggcuggguucaaaaauggggcugg

SEQ ID NO: 4246483 - RNA, 79 nt, Salmonella enterica enterica serovar Typhi
gcugguguugauaagguuggugaccauauuucccaguaccaucagggaaagaucggucggcgccuuauguuuuuccagu

SEQ ID NO: 4246484 - RNA, 121 nt, Salmonella enterica enterica serovar Typhi
gcgucuuuagcgagauaacgccggaccccaccauccauaccguggugcagggcauugcgcaaaugcaggcccugcagccgcagguggugauugguuuuggcggcggcucggcaauggacgc

SEQ ID NO: 4246485 - RNA, 63 nt, Salmonella enterica enterica serovar Typhi
acugcuguuaguguucguuaucggccucauuguguuggggccgcaacgauugccaguagcggu

SEQ ID NO: 4246486 - RNA, 58 nt, Salmonella enterica enterica serovar Typhi
gcgcgcgaacuucuucgauguuggauuucaguuucuccagcaguucguuguucggcgc

SEQ ID NO: 4246487 - RNA, 58 nt, Salmonella enterica enterica serovar Typhi
gaugcuggcguugcgaacauuuuugcgcgacaaaggaugguucgacgagcgcggcauc

SEQ ID NO: 4246488 - RNA, 61 nt, Salmonella enterica enterica serovar Typhi
uguugauggucguggaauaugcugcuggaaagcaccgggggcgguuaagcgcgcuaucgca

SEQ ID NO: 4246489 - RNA, 81 nt, Salmonella enterica enterica serovar Typhi
ucagcuuaugugcgucugcugucggugaaagauaacgaugcccgcacuuuuuacgagaaagagacgcuacguaacggcugg

SEQ ID NO: 4246490 - RNA, 58 nt, Salmonella enterica enterica serovar Typhi
uccacguugaugugaacuauucagaccuguacaccggucugauugacgucaaucuggg

SEQ ID NO: 4246491 - RNA, 70 nt, Salmonella enterica enterica serovar Typhi
uggagggaucggcagggcaaacgauuaaacgugauacaugucaccaaauuugcccugaccgaauucuuua

SEQ ID NO: 4246492 - RNA, 57 nt, Salmonella enterica enterica serovar Typhi
cgggcugcuauucguggcguuuugaauaaggcgggacguuauaagcuggcagacccg

SEQ ID NO: 4246493 - RNA, 91 nt, Salmonella enterica enterica serovar Typhi
gcggaaccgugauuaucagcguaucuucauuuucgccaacgguacguaauccgcggcgaauaauggagauauucugauaaagcguauuugc

SEQ ID NO: 4246494 - RNA, 74 nt, Salmonella enterica enterica serovar Typhi
ucauuugcuggcaguguuauggguuauuuuguugaaaaaaugcaggaaaauaccccuaauauuauugugguuga

SEQ ID NO: 4246495 - RNA, 123 nt, Salmonella enterica enterica serovar Typhi
gucgguggcgucagguaauagggcgcggacuucuaguccggcuugggucuggugcauuccgaguacggaaaaaggguccgcaaaauguccugcaauuagcgcauuaaucacgucucuaucgau

SEQ ID NO: 4246496 - RNA, 60 nt, Salmonella enterica enterica serovar Typhi
cgguggcgcuucgcuuaccggggcuacuuaucguagggcggauaagcauagcgccauccg

SEQ ID NO: 4246497 - RNA, 62 nt, Salmonella enterica enterica serovar Typhi
cuuaucugcaauaaagguugcccgucguucgcguauuggcgcgaucaguucuugcaggcagg

SEQ ID NO: 4246498 - RNA, 85 nt, Salmonella enterica enterica serovar Typhi
gguacuggaaccguacuuacugucgaaaucauuaaaguagcuggagucgcugacuuugguguaaucgacguuaaaacgccacacc

SEQ ID NO: 4246499 - RNA, 56 nt, Salmonella enterica enterica serovar Typhi
agguuauugccaaucagcaccaggcuuaucagucggucggguuuacgcaguaauuu

SEQ ID NO: 4246500 - RNA, 76 nt, Salmonella enterica enterica serovar Typhi
accgccuuuuaucgccaucacguuaauacucaaucaggugauugauguggguaaagugaugggggcauugggcggu

SEQ ID NO: 4246501 - RNA, 75 nt, Salmonella enterica enterica serovar Typhi
ggauguaacuggcagacguaaaacacgacuuauuuguauccauaaauagcgaaauguaacguuuugguuauauuu

SEQ ID NO: 4246502 - RNA, 79 nt, Salmonella enterica enterica serovar Typhi
gaucagaguugguaucaacgauagcaaauaccgggauacccagguuguucgcuucuuugauagcaaugugcucgugguc

SEQ ID NO: 4246503 - RNA, 72 nt, Salmonella enterica enterica serovar Typhi
uguggcuuaauacuggacacggcaccuuaggcuggacgauggccugcgguucaggccaguuguuaagcgaua

SEQ ID NO: 4246504 - RNA, 60 nt, Salmonella enterica enterica serovar Typhi
gacgaugggcaaucagccgcucgcgaaaccaggcgcguagaugcucuggcugcucacguu

SEQ ID NO: 4246505 - RNA, 59 nt, Salmonella enterica enterica serovar Typhi
auaacgguaaauugauugaucguccugauauucguaaggcgauugauaccuaccguuau

SEQ ID NO: 4246506 - RNA, 63 nt, Salmonella enterica enterica serovar Typhi
uuuacuuaacgguugaugacacguauucaguaaggugauaaauuguccgacuguuaacguaaa

SEQ ID NO: 4246507 - RNA, 68 nt, Salmonella enterica enterica serovar Typhi
gauuggccagauacaccggcgucagcgcauaaaaguagcccacgcccugacgcgcgcccuggcuuauc

SEQ ID NO: 4246508 - RNA, 101 nt, Salmonella enterica enterica serovar Typhi
guccaggucgguacgcuguucuacacgcgcugcuucaacauuguaggcaauacgcucuacagggcuguagcaggcgucgaccagcagacggccgauugggc

SEQ ID NO: 4246509 - RNA, 87 nt, Salmonella enterica enterica serovar Typhi
ccgucagugcgagacuuugcugggcggccucccccuuucccgguacgcggguuaugggugcguuuaucagagucaucaucacuacgg

SEQ ID NO: 4246510 - RNA, 70 nt, Salmonella enterica enterica serovar Typhi
uaccaauuugcaaauuagcuucguccauucccgcuaucguaaugaaaacgucgcgauuugcguguuggua

SEQ ID NO: 4246511 - RNA, 69 nt, Salmonella enterica enterica serovar Typhi
cguuggcgcgcaucgcuggccgcuggguuauacgcccgcguaccaagggccggucgaucuguuccugcg

SEQ ID NO: 4246512 - RNA, 56 nt, Salmonella enterica enterica serovar Typhi
ucagguaaagcgcccguggcgauugaaccucgucugccgcaagccgcuuucccuga

SEQ ID NO: 4246513 - RNA, 82 nt, Salmonella enterica enterica serovar Typhi
gccaguugggugucgacaauguugaugccaucgccgcaacggaaggcguugauggcauuuuugucggcccuagcgauuuggc

SEQ ID NO: 4246514 - RNA, 98 nt, Salmonella enterica enterica serovar Typhi
cgcgcuggcgguaauccuugcggcugucuucgcggcucaguugcugcuguagcucggcaaaggcggucugcuguuccugcagggaggacuccagcgcg

SEQ ID NO: 4246515 - RNA, 87 nt, Salmonella enterica enterica serovar Typhi
gcaggucgguaaagugcuggauaaaauuaaggcgaugggcgaggaagauaacaccaucgucaucuuuaccagcgacaacggcccugu

SEQ ID NO: 4246516 - RNA, 77 nt, Salmonella enterica enterica serovar Typhi
aaucaggcgugaguuuucaauaucggauuucaccuguucagacagaauuuccauaugaacuucacgucuuuuagauu

SEQ ID NO: 4246517 - RNA, 84 nt, Salmonella enterica enterica serovar Typhi
ugggacugguugaacggauugcuucgcuguuaguuacugguugcgcuaaugacaggcagcuuaaagcgcuguuuaauuaucuua

SEQ ID NO: 4246518 - RNA, 100 nt, Salmonella enterica enterica serovar Typhi
gaaugaccuuaauaaccacuucuuuaccguuugauuucaaucgcgcgguauguaccugggcgauugacgccgacgcuaaaggcuggauaucaaagucguc

SEQ ID NO: 4246519 - RNA, 60 nt, Salmonella enterica enterica serovar Typhi
cggauggcgcuaugcuuauccgcccuacgauaaguagccccgguaagcgaagcgccaccg

SEQ ID NO: 4246520 - RNA, 73 nt, Salmonella enterica enterica serovar Typhi
cuuccugucuaugagaauuuucguugcaaggguuaauaacucuuaacaaauagaaauuacuucauuaaggaag

SEQ ID NO: 4246521 - RNA, 56 nt, Salmonella enterica enterica serovar Typhi
uuuuuccuugcuguucagccugggcuaccgccgcaagcugauccugcaaagaagaa

SEQ ID NO: 4246522 - RNA, 89 nt, Salmonella enterica enterica serovar Typhi
cauucagcauugucuuaaccaguuuagccagcucaaaggcguagaccugagggucugcguuaguuggcaaaccuucguuaaucugaaug

SEQ ID NO: 4246523 - RNA, 97 nt, Salmonella enterica enterica serovar Typhi
gcgucaggcaaaaucgcggcuuuaucugcggggacguuauggacggaacuguaagcgccgagcguugacugcgcguagacgacgcgaucgcccacgc

SEQ ID NO: 4246524 - RNA, 110 nt, Salmonella enterica enterica serovar Typhi
cgcaugaugcgauuuuuguggcgccgagccuuuauucgcuggauuuuuaugccgaugagucgguaauagagauugggcgcguggagaaugucauggaagaauaucaugcg

SEQ ID NO: 4246525 - RNA, 63 nt, Salmonella enterica enterica serovar Typhi
cuuuucugcugcaaaaaacguucggcuagcgcaauaagccgagccuguucuugcgcggugagg

SEQ ID NO: 4246526 - RNA, 77 nt, Salmonella enterica enterica serovar Typhi
cuaauacguugaguuaucuggaaccugucccauuaaacuuucgucagaaagcuuaauaagacagguucugcguuuag

SEQ ID NO: 4246527 - RNA, 55 nt, Salmonella enterica enterica serovar Typhi
uuaaugaaucccgugauccuguccagcgcgaaauggagcaggauaaguucauuag

SEQ ID NO: 4246528 - RNA, 59 nt, Salmonella enterica enterica serovar Typhi
gugaugauuuccgucacgccugcguauaugagcuucaaacgagacggcaaaucaucgac

SEQ ID NO: 4246529 - RNA, 59 nt, Salmonella enterica enterica serovar Typhi
cgccgcaagggacggaggucucuuucuggcuggcgacagacaacggcccuuugcaggcg

SEQ ID NO: 4246530 - RNA, 83 nt, Salmonella enterica enterica serovar Typhi
gguucugacuuuguggaaauguucgugggugucggcgcaucucgugugcgugacauguucgaacaagccaagaaagcggcacc

SEQ ID NO: 4246531 - RNA, 66 nt, Salmonella enterica enterica serovar Typhi
gaagcguaacaagcaggccuggaaaauggcuuguuccggugucaggccgccgcuucguugcgcuuc

SEQ ID NO: 4246532 - RNA, 61 nt, Salmonella enterica enterica serovar Typhi
acgcucgggaucggcguggucgcgcugguggugcugguucgccacccgcugaugccggugu

SEQ ID NO: 4246533 - RNA, 63 nt, Salmonella enterica enterica serovar Typhi
ucgcgcgcucaccgacugggaugguauguggcaauccgucuauccuuaucuggucagcggcga

SEQ ID NO: 4246534 - RNA, 84 nt, Salmonella enterica enterica serovar Typhi
gucuggguggucggcgauauucacggcuguuuuucaauguuaaugaaaagguuacgugagugucaauuugauccgcaacaagac

SEQ ID NO: 4246535 - RNA, 61 nt, Salmonella enterica enterica serovar Typhi
gucuuaucgauaugcuggaagacugugacgauguucaggaagucuaccauaacggugagau

SEQ ID NO: 4246536 - RNA, 97 nt, Salmonella enterica enterica serovar Typhi
uugccgcucucuucauugaguaacaggugaggggcaaucaccuuacuguuguugaugagcgccaccaucgcuuuuaccaucuggauggggguggcaa

SEQ ID NO: 4246537 - RNA, 83 nt, Salmonella enterica enterica serovar Typhi
guuugcuuauaaccuggccgugguggucgacgaucauuuucagggggugacggagaucguccgcggcgcagauuuaaucgaac

SEQ ID NO: 4246538 - RNA, 75 nt, Salmonella enterica enterica serovar Typhi
gcggccaucauugaagaacagcuggcuaucuacaaaaccagacaaacgccacuggaucuugggcugguggugcgc

SEQ ID NO: 4246539 - RNA, 76 nt, Salmonella enterica enterica serovar Typhi
ugcccgguggcgcuagcgcuuaccgggccuacagauuuuuccauuguaggcagcauaagcguuagcgcuaucggca

SEQ ID NO: 4246540 - RNA, 74 nt, Salmonella enterica enterica serovar Typhi
uugucucccgucggguuguaauccagcgccagcaguaccggcggacgcucagaaccacggccuacgguaugcaa

SEQ ID NO: 4246541 - RNA, 55 nt, Salmonella enterica enterica serovar Typhi
auccucagaugaagcgggcgcuggauaacuucaaggccgugcuggaucugcggau

SEQ ID NO: 4246542 - RNA, 82 nt, Salmonella enterica enterica serovar Typhi
gccgcuuuauccuguuugcugauggugucaucgguuaucacacagucgaucuuguccaucggcaauaccugguuaaagccgc

SEQ ID NO: 4246543 - RNA, 66 nt, Salmonella enterica enterica serovar Typhi
gaguggaaucagccaggagucggguugaacgaagcauuuaccgcccugacgccgcuguuuucacuc

SEQ ID NO: 4246544 - RNA, 56 nt, Salmonella enterica enterica serovar Typhi
uaagccgcuauaucugggggcgcaggcgcaucugcaaccuuuuuaugcgcgguuug

SEQ ID NO: 4246545 - RNA, 118 nt, Salmonella enterica enterica serovar Typhi
cagggauauaaugaacguugucgugcuguucacuccacugcugcgguaaugcagaguaaaaaucuuuacuaucuugcauuccccaguagauguagaucucacgacgacauuuucccug

SEQ ID NO: 4246546 - RNA, 72 nt, Salmonella enterica enterica serovar Typhi
guuggugccuuuauuggcgggaucggccgacgagcauuucgacugguuuaaaguggcaaugaagguacuggc

SEQ ID NO: 4246547 - RNA, 60 nt, Salmonella enterica enterica serovar Typhi
ggcggcuacgcuuauccgcucaauaaccagagaauacuggaggcggauaagcgcagcgcc

SEQ ID NO: 4246548 - RNA, 78 nt, Salmonella enterica enterica serovar Typhi
cgacgagcagaucgcguuguuaacgaaagcgcuggaaauuaauagccagucgcuggaugacaacgcgcuguuuauucg

SEQ ID NO: 4246549 - RNA, 110 nt, Salmonella enterica enterica serovar Typhi
ugccgauggacaggauggcgugauggaaauugugaauauugacuugcuggcgacuaugcuacuugagccgcagcagccgcaaauuaccagcgccagccugacggucggca

SEQ ID NO: 4246550 - RNA, 60 nt, Salmonella enterica enterica serovar Typhi
ugaugccggauggcgguuggccuacaagaucgcaacgugcaggcgccgccauccggcaca

SEQ ID NO: 4246551 - RNA, 90 nt, Salmonella enterica enterica serovar Typhi
gccugcguaccacuuccggcgucauugccguggauaaagagagcgggaagguuaucuggcaugcagggccggaagugguagcgcagcagc

SEQ ID NO: 4246552 - RNA, 101 nt, Salmonella enterica enterica serovar Typhi
cagcucgcgauugcgacggauuguguccuggaagaagguguuaccgccaucaauaaugauaucgccuuuuuccagauacgguuucagcgaaucgauagcug

SEQ ID NO: 4246553 - RNA, 63 nt, Salmonella enterica enterica serovar Typhi
gcuggcagcaugauaauucacguugggaucuauuggaugucaugcgcgccuguuaugcgcugc

SEQ ID NO: 4246554 - RNA, 81 nt, Salmonella enterica enterica serovar Typhi
gccaaaccugcgaaccgugcgaaugcgcgacuugccgacuuugucgcgcaaauuauguauaugcacuuccagaguguuggu

SEQ ID NO: 4246555 - RNA, 65 nt, Salmonella enterica enterica serovar Typhi
gcaagcaaucgcccugucauuucaggcguuauccguaacgcgaaugauuuaggggauaaaaaugc

SEQ ID NO: 4246556 - RNA, 115 nt, Salmonella enterica enterica serovar Typhi
gguaaauagcagaaugccggauggcgaugcuaacgcgucuuauccggccuacaacgguaucucaccuguaggccggacaaggcguucacgccgccauccggcauuagcuuuuacu

SEQ ID NO: 4246557 - RNA, 57 nt, Salmonella enterica enterica serovar Typhi
ugguggcggauauggguuaugacauugagaucgucggugugccgauuauucgcgcua

SEQ ID NO: 4246558 - RNA, 119 nt, Salmonella enterica enterica serovar Typhi
guggcguaauucaucgcuggcuucggugaguuggauaguggcuucuuccagcauauccaggaugccggaaagcuugcuguccauacccaccagcucgcuaaccaguuguuuugcgcuau

SEQ ID NO: 4246559 - RNA, 61 nt, Salmonella enterica enterica serovar Typhi
acgcgcugauugauuaugauacguugccguauggcgaucaggucgguaaucaauagccugu

SEQ ID NO: 4246560 - RNA, 55 nt, Salmonella enterica enterica serovar Typhi
cgccacgauauuaccggucaucauguaguuaugaccgccggugaaaucgcugacg

SEQ ID NO: 4246561 - RNA, 98 nt, Salmonella enterica enterica serovar Typhi
uuugccgacgaucuccagcaacuguugcacugcggaaaaaguuuucgcgucuauaucaaugcggauuuuaucggcgugcagcuuggcggcgcggugaa

SEQ ID NO: 4246562 - RNA, 59 nt, Salmonella enterica enterica serovar Typhi
gcguggcgucguugaccggcgggaagucgcccgcuuccgccaggcgcugaacgucgcgc

SEQ ID NO: 4246563 - RNA, 91 nt, Salmonella enterica enterica serovar Typhi
gccgcaguugcgcgugcauccggacgacuuacagcggguggaagagaugcugggcgccacgcucagucuucacggauggcgguugcgcggc

SEQ ID NO: 4246564 - RNA, 64 nt, Salmonella enterica enterica serovar Typhi
caggcaucagacaagugaagaagcccguucugacggacgggcuucuuugcgugugugguaacug

SEQ ID NO: 4246565 - RNA, 57 nt, Salmonella enterica enterica serovar Typhi
gauugcauccggaagaguuaggucaggugcacauuucgcucaagcuggaugacaauc

SEQ ID NO: 4246566 - RNA, 62 nt, Salmonella enterica enterica serovar Typhi
ccugaaaaugaugcaggcagaucaaccauaccgaaaggaggacugucugccugauuaucagg

SEQ ID NO: 4246567 - RNA, 128 nt, Salmonella enterica enterica serovar Typhi
cgauauucuuaaaauugacggcaguuuuauucgcaauauagugucaaacagucucgauuaucagauuguggcuucuauuugucauuuagcgcgaaugaaaaauaugcaggucgucgcggaguauaucg

SEQ ID NO: 4246568 - RNA, 63 nt, Salmonella enterica enterica serovar Typhi
gggaaccggcgugaggcaggucuggcucgcggagcagacgcugaaacaacgcugggauauccc

SEQ ID NO: 4246569 - RNA, 105 nt, Salmonella enterica enterica serovar Typhi
ggcgccaccucuggcaaacagaccagaaacgguguaggccggauaagcugcuucgcguugcuauccggcuaauaacgucucaauauugucgcucggggugccgcu

SEQ ID NO: 4246570 - RNA, 100 nt, Salmonella enterica enterica serovar Typhi
uaaaaggguggcuugcguucuauugcaccaauguggugcuuaauguucacauugaagcacuauuuuggugcaacauagucaccguggugcagcccuuuug

SEQ ID NO: 4246571 - RNA, 65 nt, Salmonella enterica enterica serovar Typhi
cggcggcggcaaaucucugugcuaucaaauccccgcguuguugcuggacggauugaccgucgucg

SEQ ID NO: 4246572 - RNA, 101 nt, Salmonella enterica enterica serovar Typhi
uggucgcguagucgauaaaagcuggguagcgcgcguugccgaggugaucgacauuccguuuuguguagcgggcgguauccggucaauugacgacgccgcca

SEQ ID NO: 4246573 - RNA, 55 nt, Salmonella enterica enterica serovar Typhi
aauuguguuugucgauauucguccggauacgaugaauauugacgaaacgcugauu

SEQ ID NO: 4246574 - RNA, 78 nt, Salmonella enterica enterica serovar Typhi
gcguguugcagacggcgaaggcguuagguauucccguuaaaggccauguugagcagcuuucgcuguugggcggcgcgc

SEQ ID NO: 4246575 - RNA, 92 nt, Salmonella enterica enterica serovar Typhi
cggcgcagucaccgcgcauuuccgcgauaagcuccagaccuuuaacacaggccaucaucucauugcggcgaugcgcaggguugcugcugcug

SEQ ID NO: 4246576 - RNA, 64 nt, Salmonella enterica enterica serovar Typhi
ccggcaccaauaauggcaacuggccuuacgguacgccguauggcgugccauuguugccugucgg

SEQ ID NO: 4246577 - RNA, 108 nt, Salmonella enterica enterica serovar Typhi
gucugaaaccguauggcgucaggcaaacaaauacaaaguuccgcgcauugcguucguuaacaaaauggaccgcaugggcgcgaacuuccugaaaguuguuggucagau

SEQ ID NO: 4246578 - RNA, 88 nt, Salmonella enterica enterica serovar Typhi
aucgauguuaagaguaggugaguacgccguaaaaagaugugaggcuaaucacaaugguguaaucguuuacacuacuauuuaucucggu

SEQ ID NO: 4246579 - RNA, 80 nt, Salmonella enterica enterica serovar Typhi
ggaguuuagcgcccgggcgacauaggucagucguagugaauuaaucagacgaugacuguaauguuucccgaccgucggcc

SEQ ID NO: 4246580 - RNA, 59 nt, Salmonella enterica enterica serovar Typhi
uauggaugacugugccugcgcugccggugcccuccagaguggggguauugucguucgua

SEQ ID NO: 4246581 - RNA, 78 nt, Salmonella enterica enterica serovar Typhi
gcugguuaugacaguucauuucaugagugagaacuaucgacaaguguucugacugaugggaugcgcugagggauuagu

SEQ ID NO: 4246582 - RNA, 81 nt, Salmonella enterica enterica serovar Typhi
ggcagaccauuuucugcggcguuuugccgaacguaaccgaaaagcggugaagggguuuacgccgcaggcgauggaucugcu

SEQ ID NO: 4246583 - RNA, 78 nt, Salmonella enterica enterica serovar Typhi
uugcgguuuggcugacgaauauuauuaaaaguaaauucuuucucuuuaugaauggcguauucgucaggcacaucguga

SEQ ID NO: 4246584 - RNA, 64 nt, Salmonella enterica enterica serovar Typhi
ccguugcaggaugucgcgccggguacgccguggagcgacgugccggauaacuuccugugcccgg

SEQ ID NO: 4246585 - RNA, 97 nt, Salmonella enterica enterica serovar Typhi
gcgggacugagcagccguaacgccaugaucaucggcaccgccgguuuuaccgccaugcugugcgucauggcgcuugaagaugcagguauucgcccgc

SEQ ID NO: 4246586 - RNA, 65 nt, Salmonella enterica enterica serovar Typhi
gaaucaaaacaguccugagcgcgcugggcguuaaguaauaacaccagccaggccucguuuucguc

SEQ ID NO: 4246587 - RNA, 127 nt, Salmonella enterica enterica serovar Typhi
uuucgauaaucgagcagcgccugcgccgcgugguuaaucaacgugacuucgccgcuaccaucuacggcgauuacgcccucuuugauugacugcagcaucgccuggcguuguucaaacaggguugaga

SEQ ID NO: 4246588 - RNA, 67 nt, Salmonella enterica enterica serovar Typhi
uggcagcuagggcuuauccggccugcaaaucaucaccaaucuguaggcccgguaagcgucagcgcca

SEQ ID NO: 4246589 - RNA, 101 nt, Salmonella enterica enterica serovar Typhi
gcguugcugucuucgucgacaaucgguugauuaacggugguauccguacgguagucguauaccgcuuuggcggcgaacuguggacgaauucccgguaacgu

SEQ ID NO: 4246590 - RNA, 63 nt, Salmonella enterica enterica serovar Typhi
cacuggggaauaugguuaugcagcggacagguccauucgcagauacuguguuccccgcaugug

SEQ ID NO: 4246591 - RNA, 65 nt, Salmonella enterica enterica serovar Typhi
cuguaacuccuugugcguuucguuauguaaacaacaauauaacgauaaucucagggguuucccag

SEQ ID NO: 4246592 - RNA, 85 nt, Salmonella enterica enterica serovar Typhi
gugauauggaaagugguugaaugaagccuuagcgggaggugauucugcaucccgcuaaggccuuauugugccgcggcuucaucac

SEQ ID NO: 4246593 - RNA, 81 nt, Salmonella enterica enterica serovar Typhi
ugccggauggcggcauuaaugccuuauccggccuacaacggcaccugcccguaggccugauaagcgcagcgccaucaggca

SEQ ID NO: 4246594 - RNA, 128 nt, Salmonella enterica enterica serovar Typhi
agagccuaucccaguaggcguaauuguugaagccaguuuggggccggacagcgcgcagaaaccgugaggauuucgagcacugcccggcccuaaaauggcgaauaaaauagccuaaugggauaggcucu

SEQ ID NO: 4246595 - RNA, 66 nt, Salmonella enterica enterica serovar Typhi
acaacugccguauaucgcgcuggguaugcugaacuucuugcuacugugcgcgcugucggucuuugu

SEQ ID NO: 4246596 - RNA, 83 nt, Salmonella enterica enterica serovar Typhi
ggcggauggcgcuacgauuauccgcccuacgguuucgaccgcaggcccacguuguaggccggauaaucguagcgccauccggc

SEQ ID NO: 4246597 - RNA, 63 nt, Salmonella enterica enterica serovar Typhi
gucugaugagcgccggauucuguauucugacccugagcgcacgcugguccgccgcuuacggac

SEQ ID NO: 4246598 - RNA, 81 nt, Salmonella enterica enterica serovar Typhi
acugguguuaacgcuguauuaccaggaagagcucaaucucaaagagauuggcgcgguacuggaagucggcgaaucgcgggu

SEQ ID NO: 4246599 - RNA, 87 nt, Salmonella enterica enterica serovar Typhi
guuccuuguaggccggauaaggcggagccgccauccggcggugcagguugccugauggcgcugcgcuuaucaggccuacauuuuuac

SEQ ID NO: 4246600 - RNA, 91 nt, Salmonella enterica enterica serovar Typhi
gacgcuaauacucgcuuagugccggaaagacggcagcgccauccggcacgccaucgccugauggcgcuacgcuuaucaggccugugacguu

SEQ ID NO: 4246601 - RNA, 55 nt, Salmonella enterica enterica serovar Typhi
ucgacgcgggcaaagcuggcguggaaguugacgaccguggcuuuauccgcgucga

SEQ ID NO: 4246602 - RNA, 82 nt, Salmonella enterica enterica serovar Typhi
gccgcguccgggacgcgugaaagacuauaucgccauucccaaagcgaacggcuaucagucuuugcacaccucgaugaucggc

SEQ ID NO: 4246603 - RNA, 91 nt, Salmonella enterica enterica serovar Typhi
ggcauggacgucacggaaggaacgugaugauacagaauggugaguagggauaacgcaucauccagaucuuucgcgccuuccaguuccagcc

SEQ ID NO: 4246604 - RNA, 55 nt, Salmonella enterica enterica serovar Typhi
uaagaugagucgugcgggccugggccaugagcauaaaccugucggcucauucuug

SEQ ID NO: 4246605 - RNA, 56 nt, Salmonella enterica enterica serovar Typhi
ugggcguacucgucuauuaaugcgggccuugcaauccauuaaugaccagacguuca

SEQ ID NO: 4246606 - RNA, 79 nt, Salmonella enterica enterica serovar Typhi
gaucucgccgauccugaucccguuuaucguggcgacgcugguacgucugauucagggaucggggacgguggcgaugauc

SEQ ID NO: 4246607 - RNA, 67 nt, Salmonella enterica enterica serovar Typhi
guucgauaucgucggcauuaaccaggaugaucgcggcgacaaccugaucgugcugacgccguccgac

SEQ ID NO: 4246608 - RNA, 63 nt, Salmonella enterica enterica serovar Typhi
ucgugauccguuuguuguuucaaaauuguuaacaauuuuguaagauacgggcggauagaacga

SEQ ID NO: 4246609 - RNA, 59 nt, Salmonella enterica enterica serovar Typhi
guaaacuucuaccaugcgcucgguuuucguauugaagauagcgccuggcaggaggauac

SEQ ID NO: 4246610 - RNA, 64 nt, Salmonella enterica enterica serovar Typhi
ggcugauaucuggcccagguccgauaagcguagcgccaucaggcagguuugccggauaucagcc

SEQ ID NO: 4246611 - RNA, 62 nt, Salmonella enterica enterica serovar Typhi
uacuucuuacuaugccagccaguauuacagugacuauaagaauucuggcaguagugaaagua

SEQ ID NO: 4246612 - RNA, 66 nt, Salmonella enterica enterica serovar Typhi
acagaauggcauccgccugcucacacccuucaacgguggcuuucggcaguggaugaccaugauugu

SEQ ID NO: 4246613 - RNA, 62 nt, Salmonella enterica enterica serovar Typhi
gccgcauucagccaacugagcgcugagcgaaguuucgccagccugaguuugcgugagguggc

SEQ ID NO: 4246614 - RNA, 65 nt, Salmonella enterica enterica serovar Typhi
gcgcgcgguuugaugaucuccaccuuucauacgcuagggcuggauauuauuaagcgcgaguacgc

SEQ ID NO: 4246615 - RNA, 55 nt, Salmonella enterica enterica serovar Typhi
cagcgccuuuggaaucgacgauuaugacgucauauugucugaaaagaggaugcug

SEQ ID NO: 4246616 - RNA, 68 nt, Salmonella enterica enterica serovar Typhi
gaugagucuuaccgagcgcguuggacaucuucuuguauuaggaacgacacgaguugguaagacccguc

SEQ ID NO: 4246617 - RNA, 130 nt, Salmonella enterica enterica serovar Typhi
guaaaaccgugaguuucccgauugauaucgaggcguugaaguucuggaaucagcagaugaaauaugacgcggaacccggcaaguucaacgucuuuaucggcguggauuccgcucgcguuaaacaaggauc

SEQ ID NO: 4246618 - RNA, 67 nt, Salmonella enterica enterica serovar Typhi
gcgcguuacgcgaacaacuggaggucagggugaaccuuuccgggccgauggaugucgcgcuucgcgc

SEQ ID NO: 4246619 - RNA, 70 nt, Salmonella enterica enterica serovar Typhi
ucggacggcgaucgucggcauccagaucaacgucaucaaaguugaucugcggcucauuaucgcguucuga

SEQ ID NO: 4246620 - RNA, 99 nt, Salmonella enterica enterica serovar Typhi
ccgugcgcaucgcccgauuaucgacgaacugcaagagcggauggcggacaaaauguacgucaacuucucgcuguuccagucgaugccggacgcgugggg

SEQ ID NO: 4246621 - RNA, 69 nt, Salmonella enterica enterica serovar Typhi
gacaagugggcguuuaaucgggaagaggucauguugaccugucggccuggccaggcgcucuaugugauc

SEQ ID NO: 4246622 - RNA, 79 nt, Salmonella enterica enterica serovar Typhi
cgccuaauugaugccgcgucgcuuagugauuaucgucgccagacggggcuggucacccaggaugucgcauuauuuagcg

SEQ ID NO: 4246623 - RNA, 62 nt, Salmonella enterica enterica serovar Typhi
gcgguaaugaugccuugcugugccgccugccgcagcaccagccgcaucaauuguucuuccgu

SEQ ID NO: 4246624 - RNA, 76 nt, Salmonella enterica enterica serovar Typhi
cggguggcggcuacgccuuacccgaccuacaucgucugcuugauuuugucggucggguaagcgcuagcgccacccg

SEQ ID NO: 4246625 - RNA, 101 nt, Salmonella enterica enterica serovar Typhi
gaagacuggcaaagucaggaagguaaauuaucgaugaaugccagcgaguuuauuuacggcucgcugcacuugcucgauccaauccugaacgccgaauuuuc

SEQ ID NO: 4246626 - RNA, 90 nt, Salmonella enterica enterica serovar Typhi
gucgauucgcugcgucaggguggggcgaauauugauuaccuggagcaggaaaacuauccgccccugcgucugcgcggcgguuuuaucggc

SEQ ID NO: 4246627 - RNA, 66 nt, Salmonella enterica enterica serovar Typhi
aucgaacugaucgugggguucuuacagcgggaaagccgcaaaauagaacgcacggucagcauugau

SEQ ID NO: 4246628 - RNA, 122 nt, Salmonella enterica enterica serovar Typhi
ucaguacugagcguucauugucaucgaccaccagccacucaaagccguaagcaucgaaauccagcucaugcaacgcuuuaugguggcgauaggugugguugagaucgcgcaccagacgcuga

SEQ ID NO: 4246629 - RNA, 61 nt, Salmonella enterica enterica serovar Typhi
cggacgaacuggugccgcuucccggcgacuuagcgcuggaaaaagugcgcgccauucgccg

SEQ ID NO: 4246630 - RNA, 61 nt, Salmonella enterica enterica serovar Typhi
uaguaggggggagaauuauaguguuucccggaaacuggaagcgaguuuaccccacuuacua

SEQ ID NO: 4246631 - RNA, 58 nt, Salmonella enterica enterica serovar Typhi
gauggcggaggucaggccuuccgcguugcugccgcuggcggccgaucucucugcuauc

SEQ ID NO: 4246632 - RNA, 57 nt, Salmonella enterica enterica serovar Typhi
uuacagcgacauucccgcuucggaggauggacaguggucugaagcagugcgugguaa

SEQ ID NO: 4246633 - RNA, 69 nt, Salmonella enterica enterica serovar Typhi
ugaaacugaaguccagggcaaaggugugguuggcguccagccgcgcauugcgccuggcgaagaguauca

SEQ ID NO: 4246634 - RNA, 67 nt, Salmonella enterica enterica serovar Typhi
aggaaacucgugaagauuagcagagcggggaaacucuuuuccccgacggccucuucacgcagcgccu

SEQ ID NO: 4246635 - RNA, 59 nt, Salmonella enterica enterica serovar Typhi
ccagcucugaucguggaggguggaagugcucucgucaucgucacgauggucguagcugg

SEQ ID NO: 4246636 - RNA, 95 nt, Salmonella enterica enterica serovar Typhi
guggucgccaucaugguauggcugaauguccugacauuaaccggcccgguuuuuacgcuguggccggcaggccagccaaccgauacggugacgac

SEQ ID NO: 4246637 - RNA, 84 nt, Salmonella enterica enterica serovar Typhi
gccggauagcgccgcuucgcgucuuauccggccuacgagugagcaucuguuuacacgccggauaaggcgcagccgccauccggc

SEQ ID NO: 4246638 - RNA, 80 nt, Salmonella enterica enterica serovar Typhi
gucgauacgacccgcuuucagcagguugcccugcgcuggauuucaugcagguucgcggcauguuaaagggcuuuaucgac

SEQ ID NO: 4246639 - RNA, 92 nt, Salmonella enterica enterica serovar Typhi
ccaagugcauguaaagugguuagaguauuuuucgcaucauugucgucagagacaguuaaaccgaauauugcuuuaaccucuucaucauuugg

SEQ ID NO: 4246640 - RNA, 56 nt, Salmonella enterica enterica serovar Typhi
aucuucaugguuaauggucugauaauuacaccaucagaaccauuuuucucgaagau

SEQ ID NO: 4246641 - RNA, 70 nt, Salmonella enterica enterica serovar Typhi
gguuguugcaguuggcuaauaugcugcgcgcgcaggccgcccgcagcgguuguuaccaaagcccgcagcc

SEQ ID NO: 4246642 - RNA, 76 nt, Salmonella enterica enterica serovar Typhi
ugccggauggcgcuucgcuuauccgaccuacaaaucgugcggccuguaggccggauaagcgaagcgccauccggca

SEQ ID NO: 4246643 - RNA, 70 nt, Salmonella enterica enterica serovar Typhi
caacuggcuauggagccaaagcgcugguuugcucucggcacgauuagcgcgucguucuuaugguuuuuug

SEQ ID NO: 4246644 - RNA, 60 nt, Salmonella enterica enterica serovar Typhi
ccgcgugcccgcaguucggucugaauccugaguuuaucggaccggcugcgauuacgcugg

SEQ ID NO: 4246645 - RNA, 90 nt, Salmonella enterica enterica serovar Typhi
gcagguucgaaucuuauaaaucgcagauagcaaaaaagcgccuuuagggcgcuuuuuuacauuggugggucgugcaggauucgaaccugc

SEQ ID NO: 4246646 - RNA, 80 nt, Salmonella enterica enterica serovar Typhi
cacacagagaacuggugaaagccacuaagucucauuauuacuauauuaaggcgucagguuuuucuauaguucuuugugug

SEQ ID NO: 4246647 - RNA, 67 nt, Salmonella enterica enterica serovar Typhi
gcccguccguccgaccagggcgcauccaccugaagcaucgugguaugcgccuucagaucggaguagc

SEQ ID NO: 4246648 - RNA, 57 nt, Salmonella enterica enterica serovar Typhi
gacgccaugaagcguggguacaugacgguaaacguggguacugaugcuucguccguu

SEQ ID NO: 4246649 - RNA, 89 nt, Salmonella enterica enterica serovar Typhi
uuaccccggggauggacucacggcgcgagucagggauuucaucaccacagucccgacaaugucgucgugauacaugucccuuaauccga

SEQ ID NO: 4246650 - RNA, 74 nt, Salmonella enterica enterica serovar Typhi
cuggcggacuguucaaucugcgucucgcccaguugcaaaauggcguggacguccuguugaacggcguucaccag

SEQ ID NO: 4246651 - RNA, 67 nt, Salmonella enterica enterica serovar Typhi
guuguugcggauaauccagcguaaagugcagcccccggcucucuuuacgcaucaucgcgcaacgcac

SEQ ID NO: 4246652 - RNA, 123 nt, Salmonella enterica enterica serovar Typhi
cugccuacgcgcugguauuuaucgucaguaugcuggccauuaucgcuacaggcguagaugauuucucggcuuucgccucgguaguggcuacgcuuaauaaccugggaccggggcugggggugg

SEQ ID NO: 4246653 - RNA, 79 nt, Salmonella enterica enterica serovar Typhi
ggguuggacguauugcaaaaucgcaggccggauaagaaguaacccggccugcguauuacccgauuagcguuuuuuuccc

SEQ ID NO: 4246654 - RNA, 91 nt, Salmonella enterica enterica serovar Typhi
uuaugacuaaugcuaauuuguuggugauuuaacacauugauuuauguguuuuuuauaauaguuaucaacggaagauuaguaugaaaaauaa

SEQ ID NO: 4246655 - RNA, 60 nt, Salmonella enterica enterica serovar Typhi
uaccugugcuggcgcugaccgccccguaucauuaggcggcggauuguucagguacaggua

SEQ ID NO: 4246656 - RNA, 55 nt, Salmonella enterica enterica serovar Typhi
gcuggucgagaaugguuugcacggugguaacgcgugucugaccauccugaccggu

SEQ ID NO: 4246657 - RNA, 60 nt, Salmonella enterica enterica serovar Typhi
gguaaacgcuguguaucucucuucucccauugauggcagggagacauucagcguuucacc

SEQ ID NO: 4246658 - RNA, 71 nt, Salmonella enterica enterica serovar Typhi
gcgcugcguucgguuauugcggaagaugguaaagugcuguaccaaaguuauccgcaagcugaacgcgccgu

SEQ ID NO: 4246659 - RNA, 74 nt, Salmonella enterica enterica serovar Typhi
ccgcguuaucgccggugaugugagcaccggugccgccaucggugauggucauaucaccgucauuguugacgcgg

SEQ ID NO: 4246660 - RNA, 73 nt, Salmonella enterica enterica serovar Typhi
guuguugggcgguaucggucuggucauucugguguuuguuuuccaucuccagccagguaaaccgcccguugac

SEQ ID NO: 4246661 - RNA, 95 nt, Salmonella enterica enterica serovar Typhi
gcugacaaugugccggauggcgcuaaugcuuauccggccuacagguugucgcaacguguaggcccgguaagcgcagcgccaccgggcaacccggc

SEQ ID NO: 4246662 - RNA, 101 nt, Salmonella enterica enterica serovar Typhi
gugguuucucauguuaacgacgcuggcuucuggcuguucgguaaauuuaccggcgcgaccgaagcgcagacgcugaagaccuggacgaugauggaaacuau

SEQ ID NO: 4246663 - RNA, 72 nt, Salmonella enterica enterica serovar Typhi
aaacuaaaacggcagucaacacucguuucagccaacuugccgcuucgaauguucacugccguuauuauguuu

SEQ ID NO: 4246664 - RNA, 67 nt, Salmonella enterica enterica serovar Typhi
agccgccgugcgcggcguaauggccgccgccaacugggcggcggaacauucguuggcguaaccggcu

SEQ ID NO: 4246665 - RNA, 58 nt, Salmonella enterica enterica serovar Typhi
gcauggccaacaccggauggccgccauaucgaucagaucgccacggucuugagccagc

SEQ ID NO: 4246666 - RNA, 57 nt, Salmonella enterica enterica serovar Typhi
caucagcgucaaccguuggcgaagccugcguuuaucgcuauccgggauguguugaug

SEQ ID NO: 4246667 - RNA, 81 nt, Salmonella enterica enterica serovar Typhi
cagauuaagaucgucgcggcugaggucguuuauggaaaugauauguuuuugauauagcggguuagccauguuuaucuccug

SEQ ID NO: 4246668 - RNA, 73 nt, Salmonella enterica enterica serovar Typhi
ucgugcgcuuuuccugcgccagcuggcgaaucguauuaagcaccucgccgacuaauucaggaucaagcgccga

SEQ ID NO: 4246669 - RNA, 81 nt, Salmonella enterica enterica serovar Typhi
gacgcugugggugggguauauagaugauuaugguggacugcagaugaaccgcuacaccugugaugcccugaacugcgcguu

SEQ ID NO: 4246670 - RNA, 66 nt, Salmonella enterica enterica serovar Typhi
gucuguuauggcuuccagugcgguauuacgguguuuaucaaccucaccgguaucgucaugacaggc

SEQ ID NO: 4246671 - RNA, 62 nt, Salmonella enterica enterica serovar Typhi
acauuacacaugcucgcgcucagcaaagccuaugcgcugcugagucucaguuaugugcuugu

SEQ ID NO: 4246672 - RNA, 57 nt, Salmonella enterica enterica serovar Typhi
guccagcagugguuucauacucguccccuugcgcuauauggcgaccaccugcuggac

SEQ ID NO: 4246673 - RNA, 97 nt, Salmonella enterica enterica serovar Typhi
uucggaucuccggucugcgcgguaaaggcguaaaagcgcuucuggcggcgccgcugcggauuuuuaacgccuggcggcaggcgcgggcgaucaugaa

SEQ ID NO: 4246674 - RNA, 59 nt, Salmonella enterica enterica serovar Typhi
ggugauucagaugauugcacacgguuuguccgcagccggucuguucauucuguguggcc

SEQ ID NO: 4246675 - RNA, 129 nt, Salmonella enterica enterica serovar Typhi
gggguaaaagcagacauggaaugcuccuuaauucagacuggcggcgauuauaguaguuugauggcggagauucgacagauuugcuauauuugcgccccugauuacaggagcguuucgcuaugacauccc

SEQ ID NO: 4246676 - RNA, 82 nt, Salmonella enterica enterica serovar Typhi
cgggccgagggcgucagucgugcgucagcgggcagauggauuuccgauccuucgcugagcguaugauucgcucugagccacg

SEQ ID NO: 4246677 - RNA, 56 nt, Salmonella enterica enterica serovar Typhi
ggcgcugacguugcgccauacuggcauacgaugaugauuguggcgccugcagcguc

SEQ ID NO: 4246678 - RNA, 71 nt, Salmonella enterica enterica serovar Typhi; identical to SEQ ID NO: 4227861

SEQ ID NO: 4246679 - RNA, 55 nt, Salmonella enterica enterica serovar Typhi
uuuugccggucauccaagccgcaaccuguuuguugccggcgagaugauggcagga

SEQ ID NO: 4246680 - RNA, 62 nt, Salmonella enterica enterica serovar Typhi
accaaauccgcguuuauugauaugccguuuacgcaguggcggcaaauuuuuaccguggaugu

SEQ ID NO: 4246681 - RNA, 86 nt, Salmonella enterica enterica serovar Typhi
cggcgcgucgaccgucgcggcggcgcuuucguuguucgcuauaucgguggcgguagcgauaagcgccuggccguuagucugcgccg

SEQ ID NO: 4246682 - RNA, 56 nt, Salmonella enterica enterica serovar Typhi
gccauugcguuguuagagaaguuugcaucuuccugcuuguuaacaguugcgauggc

SEQ ID NO: 4246683 - RNA, 58 nt, Salmonella enterica enterica serovar Typhi
gcaugauuauccgcgucuuuuccacgcuuugucguggacaggacacgggauaaucagc

SEQ ID NO: 4246684 - RNA, 59 nt, Salmonella enterica enterica serovar Typhi; identical to SEQ ID NO: 4227440

SEQ ID NO: 4246685 - RNA, 56 nt, Salmonella enterica enterica serovar Typhi
uuuguuuggcuuuucaggauuauacgggcgucccguauugagauggcuauaauaga

SEQ ID NO: 4246686 - RNA, 86 nt, Salmonella enterica enterica serovar Typhi
uaucauucuguucguuaaguucauuaaugcguucuuuuucaauauugagcugcucacaggacuuaaugauggcauuacgaaugaua

SEQ ID NO: 4246687 - RNA, 60 nt, Salmonella enterica enterica serovar Typhi
gcuggacguugggggcuaccgggcgauuuaauggggccgguagucuuccuggcauccagc

SEQ ID NO: 4246688 - RNA, 102 nt, Salmonella enterica enterica serovar Typhi
gugacgcuuuucaccauguacagaauauccaucagcggcuggcgcagcguuucgcccaggcugcugaagguguucugcgcuccgguuuugaccagcaaccac

SEQ ID NO: 4246689 - RNA, 76 nt, Salmonella enterica enterica serovar Typhi
gcggcgugaaagucaccuccgugaacauuggcgguauggccuaucgucaagguaaaacgcaggugaacaacgccgu

SEQ ID NO: 4246690 - RNA, 63 nt, Salmonella enterica enterica serovar Typhi
ucagcgguuuuauuuacguugcucugggcgcguucggggcgcauguuuugaguaaaacccugg

SEQ ID NO: 4246691 - RNA, 57 nt, Salmonella enterica enterica serovar Typhi
ggcguugaacgagcaguaucagccgcguuuugcuggugaugaccugccguccaaccc

SEQ ID NO: 4246692 - RNA, 56 nt, Salmonella enterica enterica serovar Typhi
augcguuauuugaccgccugggacaauacauuccauuuaucggucugaauacgcau

SEQ ID NO: 4246693 - RNA, 56 nt, Salmonella enterica enterica serovar Typhi
ggccuggguguuauguauccuugcgggaucugcauguggugcgaugaugcuuggcc

SEQ ID NO: 4246694 - RNA, 97 nt, Salmonella enterica enterica serovar Typhi
cggagguucucauccucgucaggcuucagauacaaaaaacccugcucgcugagcaggguuucugaauuuggucggugauagaggauucgaaccuccg

SEQ ID NO: 4246695 - RNA, 55 nt, Salmonella enterica enterica serovar Typhi
ggcuagugaaaucuacgcauggcguggacagacgccauucgugaugucgauagcu

SEQ ID NO: 4246696 - RNA, 107 nt, Salmonella enterica enterica serovar Typhi
ugugugguaacuguaaaaauguaggccugauaagcgcagcgccaucaggcaaccugcaccgccggauggcggcuccgccuuauccggccuacggcaaguucggcaca

SEQ ID NO: 4246697 - RNA, 72 nt, Salmonella enterica enterica serovar Typhi
gacgaaccgagaaacagcaguuuguucacguugugcaggugcgcggcgugaauaauguugcucucuaucauc

SEQ ID NO: 4246698 - RNA, 80 nt, Salmonella enterica enterica serovar Typhi
guugccgccucgaugcauccagaaugauuuugugucuauuaaaggguuagaauuuuuucaggauaucgucgagcggcugc

SEQ ID NO: 4246699 - RNA, 86 nt, Salmonella enterica enterica serovar Typhi
acgcuuugggcgauucccggcgcgcugaccacgcaguuugccgcccugacgggagccugcaucgucggcgcgcugguguucggcgu

SEQ ID NO: 4246700 - RNA, 56 nt, Salmonella enterica enterica serovar Typhi
augcgccuucuccgccccgguuauauuccuuagauugacggcggcuaaaggcguau

SEQ ID NO: 4246701 - RNA, 80 nt, Salmonella enterica enterica serovar Typhi
cagaugcgcuggcuaucgccauuacgcauugccauguuagccagaacgcgaugcaaaugagcgagagccgacucaaucug

SEQ ID NO: 4246702 - RNA, 84 nt, Salmonella enterica enterica serovar Typhi
gcagcguauucucacguucgggcgccaucaccgccugcaacacccacagcauuuccugcgcuucgagcguuucgaauacgcugu

SEQ ID NO: 4246703 - RNA, 69 nt, Salmonella enterica enterica serovar Typhi
ggccgucuuuaacgagguacugggcgagcacaaaaaucagcuguucauuacccgugaugaagaugcgcc

SEQ ID NO: 4246704 - RNA, 70 nt, Salmonella enterica enterica serovar Typhi
auauggaucugcuguacauggcugccgcugugaugaugggucuggcggcaaucggugcugcgaucgguau

SEQ ID NO: 4246705 - RNA, 60 nt, Salmonella enterica enterica serovar Typhi
ggcugauuaucccguguccuguccacgacaaagcguggaaaagacgcggauaaucaugcu

SEQ ID NO: 4246706 - RNA, 61 nt, Salmonella enterica enterica serovar Typhi
ggugauccgauucgcguuaauguugcauucuuuugccgcaguagcguuaauugugguuauc

SEQ ID NO: 4246707 - RNA, 84 nt, Salmonella enterica enterica serovar Typhi
aagugaucguuuccgguauugguaaaucaggucauauugguaaaaaaaucgccgcgacgcuugccaguaccgguacucccgcuu

SEQ ID NO: 4246708 - RNA, 115 nt, Salmonella enterica enterica serovar Typhi
guugcgguauuuuauucggacggcuuaaaaauccagaguauuaauuuucgugguccccaugaggggcgaugagauuaauacacuggagauuuaucaugaauacguuaacugcaac

SEQ ID NO: 4246709 - RNA, 65 nt, Salmonella enterica enterica serovar Typhi
ccggaggggccggaucacagcggcgaaccacuuucugccgccgccgcuauucgcgcuaccuuugg

SEQ ID NO: 4246710 - RNA, 72 nt, Salmonella enterica enterica serovar Typhi
ggcgcaagcgccuuaucagucuacaaauuacuuuggcggcucccaaagcguaggccugauaagcgcagcgcc

SEQ ID NO: 4246711 - RNA, 67 nt, Salmonella enterica enterica serovar Typhi
gauuagcgccgguauuuuuggcgguagcgcguugcugaugcagucgccguggcugcuggcgcugguc

SEQ ID NO: 4246712 - RNA, 84 nt, Salmonella enterica enterica serovar Typhi
ugcaacaaccugggaacaagagccauuaaugacauuggcacaacagggggaguuaauggcuuuugaacacccagguuucuggca

SEQ ID NO: 4246713 - RNA, 57 nt, Salmonella enterica enterica serovar Typhi
cuggugguggucguggagcaugguaaaggugauaugagccuuuacggcuauaaccag

SEQ ID NO: 4246714 - RNA, 69 nt, Salmonella enterica enterica serovar Typhi
ugcggguugccagcacuacggcagggucgauuuucagggugauauuguccgugcugcugguaaucagca

SEQ ID NO: 4246715 - RNA, 64 nt, Salmonella enterica enterica serovar Typhi
cguuacguaugggguaugaggcggugcagucauuauuggaucgcgcgcugcccgaugcggaacg

SEQ ID NO: 4246716 - RNA, 76 nt, Salmonella enterica enterica serovar Typhi
ccguacgauuuaacgguggucggguuuggcgauagcgaugucagccgggucugccagccgccguuaaccaccaugg

SEQ ID NO: 4246717 - RNA, 85 nt, Salmonella enterica enterica serovar Typhi
guucuucuguccuucuuuuuguuuguucauuaacucauuaguauaauggugguuaacgaggaaaauaauaauagagacgauaaac

SEQ ID NO: 4246718 - RNA, 69 nt, Salmonella enterica enterica serovar Typhi
acgugucucgaugccugacuucgacguugacuucuguauggagaaacgcgaccaggugauugagcacgu

SEQ ID NO: 4246719 - RNA, 61 nt, Salmonella enterica enterica serovar Typhi
augugaauuacguugcgauaggggcucguacgaacauucaggauggcagcguucuucacgu

SEQ ID NO: 4246720 - RNA, 64 nt, Salmonella enterica enterica serovar Typhi
gcagggcggucugaaagaggcagaacuuaaagcgcugauucuggcucaguaucaggccgcaggc

SEQ ID NO: 4246721 - RNA, 62 nt, Salmonella enterica enterica serovar Typhi
cgugcuggcagaagaaauggcagacgcggcgcaaagcgcucugcuugccgcugccgguuuug

SEQ ID NO: 4246722 - RNA, 85 nt, Salmonella enterica enterica serovar Typhi
gcagcgccaccguauacggugcugaaggguucguagugaaggacauucauuucgaaggccugcagcgagucgccguuggugcggc

SEQ ID NO: 4246723 - RNA, 67 nt, Salmonella enterica enterica serovar Typhi
gucugcccgcagacauggucgugacgaacgaaaaacaccgugauaucugcgaaaaacacuggcagau

SEQ ID NO: 4246724 - RNA, 64 nt, Salmonella enterica enterica serovar Typhi
ugcguguguucaggcgugagagcauggaaaguacguuugcagcuuucgcaggugagcguaugca

SEQ ID NO: 4246725 - RNA, 71 nt, Salmonella enterica enterica serovar Typhi
cuuuugacacacaauauugacacguuggggcagaugagcugcaacccgacgaucggcgguauuggcaaggg

SEQ ID NO: 4246726 - RNA, 81 nt, Salmonella enterica enterica serovar Typhi
gccaucauguuguagcgcgucucaugcguugccgagccaauaugcggcaccgcgacgacauuagacauguucagcaggggc

SEQ ID NO: 4246727 - RNA, 62 nt, Salmonella enterica enterica serovar Typhi
cucuggcgguucuguacggcgcggugaugaaaaucgacccugccgacccggacuggccggag

SEQ ID NO: 4246728 - RNA, 79 nt, Salmonella enterica enterica serovar Typhi
ggugacggcgugccugauggcgcugugcuuaucaguccugucggauaagacgcgucgccaucuggcucguuacaucauc

SEQ ID NO: 4246729 - RNA, 103 nt, Salmonella enterica enterica serovar Typhi
ggagguacuauuucgguaaccuguuugaacuuaccuggcgccggauuaugaauuaaagcccugcacccggcagauucaggcauguuacggaaacagucgaucc

SEQ ID NO: 4246730 - RNA, 69 nt, Salmonella enterica enterica serovar Typhi
gacggcugccgccaucagcagguugaucaacaguccguuggcuuuuaccuguggauggcgaugccaguc

SEQ ID NO: 4246731 - RNA, 120 nt, Salmonella enterica enterica serovar Typhi
agugcugacuaccgucacgcuaggggcaagcguugaugugcugguuaccgaccaugguauugcggugaacccugcgcgucaggaucugcuugauaaccugcgugcugcgggcguggcgcu

SEQ ID NO: 4246732 - RNA, 75 nt, Salmonella enterica enterica serovar Typhi
ugaaaugccggauggcgguguaaacgucuuccggccuacggaaaacaugcgcguaggcccgccauucggcauuca

SEQ ID NO: 4246733 - RNA, 76 nt, Salmonella enterica enterica serovar Typhi
aaauguggcaaaccuguugguuuacguuauggcuguacggcacacccauaacggcaauuaauaaugugcuacguuu

SEQ ID NO: 4246734 - RNA, 74 nt, Salmonella enterica enterica serovar Typhi
uauugucagucaggaucugacgagcgcgauuguaguuacguucaaucagcgcuuucacuuccuggucgaugaua

SEQ ID NO: 4246735 - RNA, 71 nt, Salmonella enterica enterica serovar Typhi
gcgcguaacgaucagcuuuuugccgaaauugacgaucucaauggcggccaggaagcgauugaggagcgcgc

SEQ ID NO: 4246736 - RNA, 77 nt, Salmonella enterica enterica serovar Typhi
acaggauuacaccguggugaucgugacccauaacaugcagcaggcggcacguuguuccgaucauacggcguuuaugu

SEQ ID NO: 4246737 - RNA, 74 nt, Salmonella enterica enterica serovar Typhi
uguaggccugauaagcgcagcgccaucaggcaaccugcaccgccggauggcggcuccgccuuauccggccuaca

SEQ ID NO: 4246738 - RNA, 85 nt, Salmonella enterica enterica serovar Typhi
ccagauaguuuugccgcauggcgcuacgcuuguccggccuacagucacaggccgcgccauccggcacgccuuauuuuuuauuugg

SEQ ID NO: 4246739 - RNA, 63 nt, Salmonella enterica enterica serovar Typhi
gagcggaaccgugaguucgcggcaguacgccagugcgcacguccagaccacggaucaugucuu

SEQ ID NO: 4246740 - RNA, 83 nt, Salmonella enterica enterica serovar Typhi
acguaacgccugaagucgugacucggccuguuuuucccucagcagacgaagagacucucugaucacuucacuuugcguucugu

SEQ ID NO: 4246741 - RNA, 58 nt, Salmonella enterica enterica serovar Typhi
ugaugcagauuuucacuucucagggcguaugcuuugaugaggugcugaucugcccuca

SEQ ID NO: 4246742 - RNA, 60 nt, Salmonella enterica enterica serovar Typhi
ucaaacucaaugcuaacuacgcgaugggaauauuccagcggguuaugcaauugacgauga

SEQ ID NO: 4246743 - RNA, 90 nt, Salmonella enterica enterica serovar Typhi
auacgauggcgacgauaaucauguauggcguuuguaccgauaacaccaggcuguguuuauaggcgcuaagcugauccggcgucauuuuau

SEQ ID NO: 4246744 - RNA, 66 nt, Salmonella enterica enterica serovar Typhi
accagauggugaacggcaggaaaugguucgacgacgaacaguuccggcacuuucaccgaaccuggu

SEQ ID NO: 4246745 - RNA, 57 nt, Salmonella enterica enterica serovar Typhi
ugcgcccugcgccaguuguuccagaaugguuuucaggaacgggcuuuucagggugua

SEQ ID NO: 4246746 - RNA, 88 nt, Salmonella enterica enterica serovar Typhi
cagcccggauacggauaaagcguuguucuggggaaauaugucggauacgacauccgucaacggaaaaacgcugcaucguccguggcug

SEQ ID NO: 4246747 - RNA, 68 nt, Salmonella enterica enterica serovar Typhi
guaagugaggugcuaugaugaggugagcgaaagggacguugcugccaucguuuuuguaccguaucggc

SEQ ID NO: 4246748 - RNA, 91 nt, Salmonella enterica enterica serovar Typhi
cgcggacgccguggcacauuaaugcgcggccugcagcguaucgaucgcauugagauugauucgccgcaucgcguaagucauggcgacagcg

SEQ ID NO: 4246749 - RNA, 91 nt, Salmonella enterica enterica serovar Typhi
gcagguaucacugcugaauguccgacucaaacugaaaucgugcugaaaggcgcugauaagcaggugaucggccagguugcagcagaucugc

SEQ ID NO: 4246750 - RNA, 129 nt, Salmonella enterica enterica serovar Typhi
acgcaagagguaaugcccgauggcgcugcguuuauuaggccuacaagaauuuaucgcaauauacugauauugcaaaucuuguaggccggauaaggcgcagccgccauccggcacaguauuaccgcucgu

SEQ ID NO: 4246751 - RNA, 75 nt, Salmonella enterica enterica serovar Typhi
gccuucuccguuaaucuguugcgucguacuuuuuguguuugcuugacuaaaaaaugccgcaaaggcguggaaggc

SEQ ID NO: 4246752 - RNA, 74 nt, Salmonella enterica enterica serovar Typhi Ty2; identical to SEQ ID NO: 4246184

SEQ ID NO: 4246753 - RNA, 56 nt, Salmonella enterica enterica serovar Typhi Ty2; identical to SEQ ID NO: 4246512

SEQ ID NO: 4246754 - RNA, 56 nt, Salmonella enterica enterica serovar Typhi Ty2
gcgcuggaaagcggcaggugauagugcguucgaaucagcugcugcgcuuuccaggc

SEQ ID NO: 4246755 - RNA, 93 nt, Salmonella enterica enterica serovar Typhi Ty2; identical to SEQ ID NO: 4246349

SEQ ID NO: 4246756 - RNA, 57 nt, Salmonella enterica enterica serovar Typhi Ty2; identical to SEQ ID NO: 4245841

SEQ ID NO: 4246757 - RNA, 67 nt, Salmonella enterica enterica serovar Typhi Ty2
uguggcguauucuacgcgcaaucgcagaaaucagaaaagcagcgaugccguugaauccagcgccgca

SEQ ID NO: 4246758 - RNA, 76 nt, Salmonella enterica enterica serovar Typhi Ty2
aguguauaaggcgcgaugcuggcgaaggucugcucuuuaucccacgggcagccguuuuccgggucgcgcaggcgcu

SEQ ID NO: 4246759 - RNA, 56 nt, Salmonella enterica enterica serovar Typhi Ty2; identical to SEQ ID NO: 4246087

SEQ ID NO: 4246760 - RNA, 92 nt, Salmonella enterica enterica serovar Typhi Ty2
gcaucagcuauuucugcacaccuggcgucagcaguguagcgagaaaaaagcgcaggccaaaggcuggcgucaguggcuggaagaggagaugc

SEQ ID NO: 4246761 - RNA, 86 nt, Salmonella enterica enterica serovar Typhi Ty2
gccggugaguuugaccguuaucugcugcugccgcauaacccgaauauggucauugucgauacgcagauaguggcgggcgcgccggc

SEQ ID NO: 4246762 - RNA, 80 nt, Salmonella enterica enterica serovar Typhi Ty2
agcgcgcagcuucgauugcauccggaagaguuaggucaggugcacauuucgcucaagcuggaugacaaucaggcgcagcu

SEQ ID NO: 4246763 - RNA, 84 nt, Salmonella enterica enterica serovar Typhi Ty2
ggcauggugcggcgcgacgguuugcaaaugggugauaggguccgguucaucgccauacggcagacgcgcgcccggcguagugcc

SEQ ID NO: 4246764 - RNA, 81 nt, Salmonella enterica enterica serovar Typhi Ty2; identical to SEQ ID NO: 4246111

SEQ ID NO: 4246765 - RNA, 68 nt, Salmonella enterica enterica serovar Typhi Ty2; identical to SEQ ID NO: 4246271

SEQ ID NO: 4246766 - RNA, 100 nt, Salmonella enterica enterica serovar Typhi Ty2; identical to SEQ ID NO: 4246106

SEQ ID NO: 4246767 - RNA, 101 nt, Salmonella enterica enterica serovar Typhi Ty2; identical to SEQ ID NO: 4246552

SEQ ID NO: 4246768 - RNA, 80 nt, Salmonella enterica enterica serovar Typhi Ty2
aggcgguggcggcggcggaacaucggcauuaauggugaaaaugaccguauaguugccgccguuuugccgcuucaccgccu

SEQ ID NO: 4246769 - RNA, 77 nt, Salmonella enterica enterica serovar Typhi Ty2
gaggaagguacugccagaggucugacggaucccuuugcgaauaacauccucaacuucagcagauaccauuacugcuc

SEQ ID NO: 4246770 - RNA, 75 nt, Salmonella enterica enterica serovar Typhi Ty2
gauggugacuugcaacuugcagacugauaucuggguuaauaccacauuuucagcucugaaguacaaauuuucauc

SEQ ID NO: 4246771 - RNA, 70 nt, Salmonella enterica enterica serovar Typhi Ty2
gccgcagcgcuacgcgcagauaggcagcgucaugaugacgcaugacuaucugcgcuggugcuuaaccggc

SEQ ID NO: 4246772 - RNA, 73 nt, Salmonella enterica enterica serovar Typhi Ty2; identical to SEQ ID NO: 4246439

SEQ ID NO: 4246773 - RNA, 85 nt, Salmonella enterica enterica serovar Typhi Ty2; identical to SEQ ID NO: 4246738

SEQ ID NO: 4246774 - RNA, 106 nt, Salmonella enterica enterica serovar Typhi Ty2
guauaauuugccggauggcgacgcaaugcgucuuauccggccuacggauugauacggauugauguuguaggccugauaagcgaagcgccgucaggcaguguuaugc

SEQ ID NO: 4246775 - RNA, 80 nt, Salmonella enterica enterica serovar Typhi Ty2
ccguugcccgccuguuggaaguaccaggcguguggcguuuuauccacauccguggugauuucaucaauccucggcagcgg

SEQ ID NO: 4246776 - RNA, 61 nt, Salmonella enterica enterica serovar Typhi Ty2
agcgacaggaaucugugugaggcagaaaauccccauaaacuucacaacagacccugucgcu

SEQ ID NO: 4246777 - RNA, 72 nt, Salmonella enterica enterica serovar Typhi Ty2
guguuuuuuauauauagcugauuauuauucugaaaugucaauuuuugaauaacgacgcugugauaccggcac

SEQ ID NO: 4246778 - RNA, 65 nt, Salmonella enterica enterica serovar Typhi Ty2; identical to SEQ ID NO: 4245849

SEQ ID NO: 4246779 - RNA, 58 nt, Salmonella enterica enterica serovar Typhi Ty2; identical to SEQ ID NO: 4245968

SEQ ID NO: 4246780 - RNA, 82 nt, Salmonella enterica enterica serovar Typhi Ty2; identical to SEQ ID NO: 4245935

SEQ ID NO: 4246781 - RNA, 56 nt, Salmonella enterica enterica serovar Typhi Ty2; identical to SEQ ID NO: 4246682

SEQ ID NO: 4246782 - RNA, 71 nt, Salmonella enterica enterica serovar Typhi Ty2; identical to SEQ ID NO: 4246735

SEQ ID NO: 4246783 - RNA, 58 nt, Salmonella enterica enterica serovar Typhi Ty2
ugggacuaugcuaaacgcucgauggagaugucguugcguugggcgaagcguagccgcg

SEQ ID NO: 4246784 - RNA, 61 nt, Salmonella enterica enterica serovar Typhi Ty2
gaggugugcaaagacugauagccguucgcuuugggaauggcgauauagucuuucacgcguc

SEQ ID NO: 4246785 - RNA, 69 nt, Salmonella enterica enterica serovar Typhi Ty2; identical to SEQ ID NO: 4245942

SEQ ID NO: 4246786 - RNA, 70 nt, Salmonella enterica enterica serovar Typhi Ty2
caguagucacucucacuuuugugacguuugggaugcauuuucuuacguucuggugggagcuggcgcgcug

SEQ ID NO: 4246787 - RNA, 61 nt, Salmonella enterica enterica serovar Typhi Ty2; identical to SEQ ID NO: 4246126

SEQ ID NO: 4246788 - RNA, 67 nt, Salmonella enterica enterica serovar Typhi Ty2
gcuggaugaaacuggcuggacaggucgcggcagagcguagcgaaggaccgggcagcuucaucccggc

SEQ ID NO: 4246789 - RNA, 56 nt, Salmonella enterica enterica serovar Typhi Ty2; identical to SEQ ID NO: 4246427

SEQ ID NO: 4246790 - RNA, 100 nt, Salmonella enterica enterica serovar Typhi Ty2
cgccggguggcgacgcgggugcgucuuacccggccuacgguucgguacugcuucgugcaucguuuuuuuguaggcccggucagcgcagcgccaccgggcg

SEQ ID NO: 4246791 - RNA, 61 nt, Salmonella enterica enterica serovar Typhi Ty2; identical to SEQ ID NO: 4246399

SEQ ID NO: 4246792 - RNA, 55 nt, Salmonella enterica enterica serovar Typhi Ty2
uuccagaucgagaaccgacagcagcauauccugauugcggcgagagauuugcgaa

SEQ ID NO: 4246793 - RNA, 83 nt, Salmonella enterica enterica serovar Typhi Ty2
uugcuguuccuggcgcucgcggacgucgaggaucugguuguuaaucagaccuucuucgauuucgcgcagcgcgauaacgguag

SEQ ID NO: 4246794 - RNA, 77 nt, Salmonella enterica enterica serovar Typhi Ty2
cccagcgccgccaauaucguugcuuaugccgaaauugugcgcgaguacagucguaagcgacggcugguuaagcuggg

SEQ ID NO: 4246795 - RNA, 83 nt, Salmonella enterica enterica serovar Typhi Ty2; identical to SEQ ID NO: 4246455

SEQ ID NO: 4246796 - RNA, 72 nt, Salmonella enterica enterica serovar Typhi Ty2; identical to SEQ ID NO: 4246710

SEQ ID NO: 4246797 - RNA, 57 nt, Salmonella enterica enterica serovar Typhi Ty2; identical to SEQ ID NO: 4246713

SEQ ID NO: 4246798 - RNA, 83 nt, Salmonella enterica enterica serovar Typhi Ty2
cgcgcuggucggcacgcacggucugcacgucacuuccgguuugaucuggauggcggugcugauggugcaagucgcccgucgcg

SEQ ID NO: 4246799 - RNA, 58 nt, Salmonella enterica enterica serovar Typhi Ty2
cuuagaaaugcagagaaaaaacgccgcagaacgcggcguugacaagguauuuuuacag

SEQ ID NO: 4246800 - RNA, 110 nt, Salmonella enterica enterica serovar Typhi Ty2; identical to SEQ ID NO: 4246524

SEQ ID NO: 4246801 - RNA, 64 nt, Salmonella enterica enterica serovar Typhi Ty2; identical to SEQ ID NO: 4245817

SEQ ID NO: 4246802 - RNA, 59 nt, Salmonella enterica enterica serovar Typhi Ty2
gccggaacgggagaucacugccucaaugcgggcaaucucuacaauauccguucccaggc

SEQ ID NO: 4246803 - RNA, 77 nt, Salmonella enterica enterica serovar Typhi Ty2
aucaaaacggcaauuuucuuacucaugcguuuccuccgcagugguggcgucggguaaggcaaauuuuccacaaugau

SEQ ID NO: 4246804 - RNA, 68 nt, Salmonella enterica enterica serovar Typhi Ty2; identical to SEQ ID NO: 4246195

SEQ ID NO: 4246805 - RNA, 88 nt, Salmonella enterica enterica serovar Typhi Ty2; identical to SEQ ID NO: 4245796

SEQ ID NO: 4246806 - RNA, 59 nt, Salmonella enterica enterica serovar Typhi Ty2; identical to SEQ ID NO: 4246104

SEQ ID NO: 4246807 - RNA, 58 nt, Salmonella enterica enterica serovar Typhi Ty2; identical to SEQ ID NO: 4246424

SEQ ID NO: 4246808 - RNA, 89 nt, Salmonella enterica enterica serovar Typhi Ty2
gccagaaaacacccgacuuaacgcugugcuggauuauauugacgcgguaacggcaacagauaccagcacagcgccggacgucaucuggc

SEQ ID NO: 4246809 - RNA, 86 nt, Salmonella enterica enterica serovar Typhi Ty2
agaugucgguaagauugcucgcgaggcccacgugaaaaaacugguguuaagucaucuggugccugcgacgguugcggaugacgucu

SEQ ID NO: 4246810 - RNA, 66 nt, Salmonella enterica enterica serovar Typhi Ty2
uuuuguaaugugggcugucgcccagaugcgcuucugucucguccggaacgugauaguccaucagaa

SEQ ID NO: 4246811 - RNA, 130 nt, Salmonella enterica enterica serovar Typhi Ty2; identical to SEQ ID NO: 4245880

SEQ ID NO: 4246812 - RNA, 76 nt, Salmonella enterica enterica serovar Typhi Ty2; identical to SEQ ID NO: 4246423

SEQ ID NO: 4246813 - RNA, 56 nt, Salmonella enterica enterica serovar Typhi Ty2
aacgccguauuuacgggaggccuggcguaccaugccaauguauuuaugcgcgcguu

SEQ ID NO: 4246814 - RNA, 69 nt, Salmonella enterica enterica serovar Typhi Ty2; identical to SEQ ID NO: 4245878

SEQ ID NO: 4246815 - RNA, 83 nt, Salmonella enterica enterica serovar Typhi Ty2
cgcucguuucgcaaacaacaucuuuguugacgguaacuuaagcuacucucacuucaacaacgauuugucugcuaacaugagcg

SEQ ID NO: 4246816 - RNA, 119 nt, Salmonella enterica enterica serovar Typhi Ty2
aaggcuaucuuguuugccauuuuagccccggggugugcucgaaaugcucacguacugcguguacgcuccgcuuucugcgcgcacgccggagcuaaacuggcugcaccgauauacgccuu

SEQ ID NO: 4246817 - RNA, 60 nt, Salmonella enterica enterica serovar Typhi Ty2; identical to SEQ ID NO: 4246547

SEQ ID NO: 4246818 - RNA, 80 nt, Salmonella enterica enterica serovar Typhi Ty2; identical to SEQ ID NO: 4246579

SEQ ID NO: 4246819 - RNA, 96 nt, Salmonella enterica enterica serovar Typhi Ty2
gcugauguggagauuuuugccccggaaggcgaagugcgggcgcagaaaaccuauaacucgcggcuuggcauucuuggcggcauuuccauuauuggc

SEQ ID NO: 4246820 - RNA, 130 nt, Salmonella enterica enterica serovar Typhi Ty2; identical to SEQ ID NO: 4246077

SEQ ID NO: 4246821 - RNA, 72 nt, Salmonella enterica enterica serovar Typhi Ty2; identical to SEQ ID NO: 4246070

SEQ ID NO: 4246822 - RNA, 59 nt, Salmonella enterica enterica serovar Typhi Ty2; identical to SEQ ID NO: 4246635

SEQ ID NO: 4246823 - RNA, 97 nt, Salmonella enterica enterica serovar Typhi Ty2; identical to SEQ ID NO: 4246078

SEQ ID NO: 4246824 - RNA, 57 nt, Salmonella enterica enterica serovar Typhi Ty2; identical to SEQ ID NO: 4246299

SEQ ID NO: 4246825 - RNA, 80 nt, Salmonella enterica enterica serovar Typhi Ty2
gccaguuuauuugccagcauauagcucagcgcacugcccagauuuucaugcuugaguagcguggcgugauaaaaacuggc

SEQ ID NO: 4246826 - RNA, 75 nt, Salmonella enterica enterica serovar Typhi Ty2; identical to SEQ ID NO: 4246189

SEQ ID NO: 4246827 - RNA, 67 nt, Salmonella enterica enterica serovar Typhi Ty2; identical to SEQ ID NO: 4246723

SEQ ID NO: 4246828 - RNA, 67 nt, Salmonella enterica enterica serovar Typhi Ty2; identical to SEQ ID NO: 4246143

SEQ ID NO: 4246829 - RNA, 60 nt, Salmonella enterica enterica serovar Typhi Ty2; identical to SEQ ID NO: 4246381

SEQ ID NO: 4246830 - RNA, 66 nt, Salmonella enterica enterica serovar Typhi Ty2; identical to SEQ ID NO: 4246236

SEQ ID NO: 4246831 - RNA, 64 nt, Salmonella enterica enterica serovar Typhi Ty2; identical to SEQ ID NO: 4246287

SEQ ID NO: 4246832 - RNA, 83 nt, Salmonella enterica enterica serovar Typhi Ty2
cugaacuggcgcauauugucgaugagacgcuggcggcuaauaaccuggaucgcucagaacucgauuggcuggugccgcaucag

SEQ ID NO: 4246833 - RNA, 66 nt, Salmonella enterica enterica serovar Typhi Ty2
gcggcggcggcuggcguuugugggucgcuauugcugacgugagcuauuauguacggccgccaacgc

SEQ ID NO: 4246834 - RNA, 79 nt, Salmonella enterica enterica serovar Typhi Ty2; identical to SEQ ID NO: 4245835

SEQ ID NO: 4246835 - RNA, 59 nt, Salmonella enterica enterica serovar Typhi Ty2
gcuguucgcgauacugcgccaacgcuuucucgaaaaugucgugcauaucggugaacggc

SEQ ID NO: 4246836 - RNA, 78 nt, Salmonella enterica enterica serovar Typhi Ty2; identical to SEQ ID NO: 4245745

SEQ ID NO: 4246837 - RNA, 84 nt, Salmonella enterica enterica serovar Typhi Ty2
ugggccaggacccggaaguacgcuauaugccgaguggcggugcugucgccaacuuaacgcuggcuacuucugaauccuggcgcg

SEQ ID NO: 4246838 - RNA, 80 nt, Salmonella enterica enterica serovar Typhi Ty2
cauaucaccaaucugguguucuccauuuugcgcaacgcccgggcgcugcacgucggcgaagcgccaaacauggugguaug

SEQ ID NO: 4246839 - RNA, 87 nt, Salmonella enterica enterica serovar Typhi Ty2; identical to SEQ ID NO: 4245766

SEQ ID NO: 4246840 - RNA, 76 nt, Salmonella enterica enterica serovar Typhi Ty2; identical to SEQ ID NO: 4246390

SEQ ID NO: 4246841 - RNA, 74 nt, Salmonella enterica enterica serovar Typhi Ty2; identical to SEQ ID NO: 4245959

SEQ ID NO: 4246842 - RNA, 64 nt, Salmonella enterica enterica serovar Typhi Ty2; identical to SEQ ID NO: 4245746

SEQ ID NO: 4246843 - RNA, 60 nt, Salmonella enterica enterica serovar Typhi Ty2; identical to SEQ ID NO: 4246358

SEQ ID NO: 4246844 - RNA, 62 nt, Salmonella enterica enterica serovar Typhi Ty2; identical to SEQ ID NO: 4245850

SEQ ID NO: 4246845 - RNA, 55 nt, Salmonella enterica enterica serovar Typhi Ty2; identical to SEQ ID NO: 4246573

SEQ ID NO: 4246846 - RNA, 97 nt, Salmonella enterica enterica serovar Typhi Ty2; identical to SEQ ID NO: 4246293

SEQ ID NO: 4246847 - RNA, 61 nt, Salmonella enterica enterica serovar Typhi Ty2; identical to SEQ ID NO: 4246488

SEQ ID NO: 4246848 - RNA, 88 nt, Salmonella enterica enterica serovar Typhi Ty2; identical to SEQ ID NO: 4245856

SEQ ID NO: 4246849 - RNA, 60 nt, Salmonella enterica enterica serovar Typhi Ty2; identical to SEQ ID NO: 4246185

SEQ ID NO: 4246850 - RNA, 110 nt, Salmonella enterica enterica serovar Typhi Ty2
cgcguaauaucgagguuaacggcccgacaacagacaugauaggcgaagcgcccgccaugcaggauguguuucgcauuauuggucggcugucgcguucuucgauuagcgug

SEQ ID NO: 4246851 - RNA, 60 nt, Salmonella enterica enterica serovar Typhi Ty2
ggcauuuugcuggagucguucaccugggacagugagguggauaacaucaacaggaugacc

SEQ ID NO: 4246852 - RNA, 126 nt, Salmonella enterica enterica serovar Typhi Ty2; identical to SEQ ID NO: 4246068

SEQ ID NO: 4246853 - RNA, 97 nt, Salmonella enterica enterica serovar Typhi Ty2; identical to SEQ ID NO: 4246585

SEQ ID NO: 4246854 - RNA, 61 nt, Salmonella enterica enterica serovar Typhi Ty2; identical to SEQ ID NO: 4246286

SEQ ID NO: 4246855 - RNA, 84 nt, Salmonella enterica enterica serovar Typhi Ty2
caucauauuuuuucuccgugaaugaguaauuaaccguuaguaauaaccggucugucauucacggaagacacaaaaucguagaug

SEQ ID NO: 4246856 - RNA, 118 nt, Salmonella enterica enterica serovar Typhi Ty2; identical to SEQ ID NO: 4246545

SEQ ID NO: 4246857 - RNA, 77 nt, Salmonella enterica enterica serovar Typhi Ty2; identical to SEQ ID NO: 4246445

SEQ ID NO: 4246858 - RNA, 91 nt, Salmonella enterica enterica serovar Typhi Ty2; identical to SEQ ID NO: 4246654

SEQ ID NO: 4246859 - RNA, 75 nt, Salmonella enterica enterica serovar Typhi Ty2; identical to SEQ ID NO: 4246732

SEQ ID NO: 4246860 - RNA, 65 nt, Salmonella enterica enterica serovar Typhi Ty2
gguagauugacugcuaugcugagaggaucuugccagaucaucgcgcgcguaaaguuagguaaauc

SEQ ID NO: 4246861 - RNA, 56 nt, Salmonella enterica enterica serovar Typhi Ty2; identical to SEQ ID NO: 4246640

SEQ ID NO: 4246862 - RNA, 58 nt, Salmonella enterica enterica serovar Typhi Ty2
ugugcguauugccccccaugggaagcauaagaacauccccauggcggcauaacacaca

SEQ ID NO: 4246863 - RNA, 63 nt, Salmonella enterica enterica serovar Typhi Ty2; identical to SEQ ID NO: 4245831

SEQ ID NO: 4246864 - RNA, 107 nt, Salmonella enterica enterica serovar Typhi Ty2
uuuuacgguaaagagugcauuucaucaaugaacagcgugcuacagauuucuuuuuaaaucauuauguuaaugcuuuuauugaauguucuguccucguguuaguacaa

SEQ ID NO: 4246865 - RNA, 56 nt, Salmonella enterica enterica serovar Typhi Ty2
ugccgcguaaagcacgaacgggcggaauuugcccuucggaccaauuuuacgccgcg

SEQ ID NO: 4246866 - RNA, 59 nt, Salmonella enterica enterica serovar Typhi Ty2; identical to SEQ ID NO: 4246505

SEQ ID NO: 4246867 - RNA, 71 nt, Salmonella enterica enterica serovar Typhi Ty2
gauguucucuccugauaucacggauaugcgccgcgagggcgcauauccugugggauuagucgccgagcguc

SEQ ID NO: 4246868 - RNA, 93 nt, Salmonella enterica enterica serovar Typhi Ty2
acgguuucgaggguuuaccuuugaaggucggcagcagggugacaccguaguugacuuugcucuugucgauguucgaccaugcccacggaccgu

SEQ ID NO: 4246869 - RNA, 84 nt, Salmonella enterica enterica serovar Typhi Ty2; identical to SEQ ID NO: 4246283

SEQ ID NO: 4246870 - RNA, 80 nt, Salmonella enterica enterica serovar Typhi Ty2; identical to SEQ ID NO: 4246278

SEQ ID NO: 4246871 - RNA, 78 nt, Salmonella enterica enterica serovar Typhi Ty2; identical to SEQ ID NO: 4246308

SEQ ID NO: 4246872 - RNA, 80 nt, Salmonella enterica enterica serovar Typhi Ty2
gcaaaugcuucgcuaugaaauucuuuccggcaauauaaaagcgggagaagaacucgcgcaggaaaguauugcggagcagc

SEQ ID NO: 4246873 - RNA, 74 nt, Salmonella enterica enterica serovar Typhi Ty2
gcauaaccugcacuauucugaagaucacggcguguugauuaucaucgccauuaugaucgggaugcuguuugugc

SEQ ID NO: 4246874 - RNA, 112 nt, Salmonella enterica enterica serovar Typhi Ty2
gcuggaugcugcuuaacguguugcgcggcaugacguugacgucgcuaccgcugcgucuggccgucagccgacuucugcgucagccguggucaacguugagucagcuuucggc

SEQ ID NO: 4246875 - RNA, 71 nt, Salmonella enterica enterica serovar Typhi Ty2
uuauggcgcgggggaaaagauggucgauauccucauccguaucgcguuaaucuuauucuucuccgccgugg

SEQ ID NO: 4246876 - RNA, 56 nt, Salmonella enterica enterica serovar Typhi Ty2; identical to SEQ ID NO: 4246456

SEQ ID NO: 4246877 - RNA, 76 nt, Salmonella enterica enterica serovar Typhi Ty2
gugguggcgcgggggccggucgcggcagcgucugcugaugcggcucacguugcgacaccugcuccggcggccaaac

SEQ ID NO: 4246878 - RNA, 70 nt, Salmonella enterica enterica serovar Typhi Ty2
ccggucauggucugggggaugaucggcgauaacaugauggugaccggcgacaaccgcagccuguggcugg

SEQ ID NO: 4246879 - RNA, 84 nt, Salmonella enterica enterica serovar Typhi Ty2; identical to SEQ ID NO: 4246214

SEQ ID NO: 4246880 - RNA, 70 nt, Salmonella enterica enterica serovar Typhi Ty2
gggcgcggacuucuaguccggcuugggucuggugcauuccgaguacggaaaaaggguccgcaaaaugucc

SEQ ID NO: 4246881 - RNA, 61 nt, Salmonella enterica enterica serovar Typhi Ty2
gaacggcgcuauugucgggaugaccaccuucggugaauccgccccggcagagcugcuguuu

SEQ ID NO: 4246882 - RNA, 77 nt, Salmonella enterica enterica serovar Typhi Ty2
gcacgaccgaaagucgcuguacugcgcgagcagggggugaacucucacguggagauggcggcggcguuccaucgugc

SEQ ID NO: 4246883 - RNA, 119 nt, Salmonella enterica enterica serovar Typhi Ty2; identical to SEQ ID NO: 4246558

SEQ ID NO: 4246884 - RNA, 83 nt, Salmonella enterica enterica serovar Typhi Ty2
cacuauugcuguuccucguauccgugacuuccguggcuuguccgcuaagucauucgacggucgugguaacuacagcaugggug

SEQ ID NO: 4246885 - RNA, 62 nt, Salmonella enterica enterica serovar Typhi Ty2; identical to SEQ ID NO: 4245944

SEQ ID NO: 4246886 - RNA, 93 nt, Salmonella enterica enterica serovar Typhi Ty2
gcugucugauggcguugaacuuguccggccuggcgauauugaccauggugcauaucgccaggcacggauaaggugcgugcgccgccauccggc

SEQ ID NO: 4246887 - RNA, 62 nt, Salmonella enterica enterica serovar Typhi Ty2; identical to SEQ ID NO: 4245802

SEQ ID NO: 4246888 - RNA, 69 nt, Salmonella enterica enterica serovar Typhi Ty2; identical to SEQ ID NO: 4246298

SEQ ID NO: 4246889 - RNA, 59 nt, Salmonella enterica enterica serovar Typhi Ty2; identical to SEQ ID NO: 4245748

SEQ ID NO: 4246890 - RNA, 57 nt, Salmonella enterica enterica serovar Typhi Ty2; identical to SEQ ID NO: 4246134

SEQ ID NO: 4246891 - RNA, 57 nt, Salmonella enterica enterica serovar Typhi Ty2
gaggaucauauugucgcgguacaggucgguaaugagccgggcgaaaaauugauccuc

SEQ ID NO: 4246892 - RNA, 71 nt, Salmonella enterica enterica serovar Typhi Ty2; identical to SEQ ID NO: 4246041

SEQ ID NO: 4246893 - RNA, 68 nt, Salmonella enterica enterica serovar Typhi Ty2
gauaucaacguuaugauaauaaugaggccgacgggaacgguaaucauaauaaucugacgguuggcguc

SEQ ID NO: 4246894 - RNA, 57 nt, Salmonella enterica enterica serovar Typhi Ty2; identical to SEQ ID NO: 4246201

SEQ ID NO: 4246895 - RNA, 84 nt, Salmonella enterica enterica serovar Typhi Ty2
cgacgauccggagccaggcaaucgaucagggcagcgcgagguuucacguugucacagguguugccgguaaccggguuagauucg

SEQ ID NO: 4246896 - RNA, 72 nt, Salmonella enterica enterica serovar Typhi Ty2
acgacgcuuaaucguauccuggaugagcuaccuuuauuagagucccgugggcaccagguacugauuagucgu

SEQ ID NO: 4246897 - RNA, 57 nt, Salmonella enterica enterica serovar Typhi Ty2
caacaacuuaucgccggagaagcuuaccaggcugacgccugcggcaaugagcuguug

SEQ ID NO: 4246898 - RNA, 78 nt, Salmonella enterica enterica serovar Typhi Ty2
ccccaccauccauaccguggugcagggcauugcgcaaaugcaggcccugcagccgcagguggugauugguuuuggcgg

SEQ ID NO: 4246899 - RNA, 83 nt, Salmonella enterica enterica serovar Typhi Ty2; identical to SEQ ID NO: 4246530

SEQ ID NO: 4246900 - RNA, 78 nt, Salmonella enterica enterica serovar Typhi Ty2
gcccggcaacugacuuuguuacuggccggugguaccagcacuggcgccccgccagcaaaucaaguagucgcugcccgc

SEQ ID NO: 4246901 - RNA, 64 nt, Salmonella enterica enterica serovar Typhi Ty2; identical to SEQ ID NO: 4246187

SEQ ID NO: 4246902 - RNA, 77 nt, Salmonella enterica enterica serovar Typhi Ty2
auaaacauaauaacggcagugaacauucgaagcggcaaguuggcugaaacgaguguugacugccguuuuaguuuugu

SEQ ID NO: 4246903 - RNA, 81 nt, Salmonella enterica enterica serovar Typhi Ty2
ggcugucgccacguuucugcgacguuaucgguaaacguguuaaaccacccuuuauccgccgcagagacugaaggaauagcc

SEQ ID NO: 4246904 - RNA, 81 nt, Salmonella enterica enterica serovar Typhi Ty2; identical to SEQ ID NO: 4246726

SEQ ID NO: 4246905 - RNA, 63 nt, Salmonella enterica enterica serovar Typhi Ty2; identical to SEQ ID NO: 4246739

SEQ ID NO: 4246906 - RNA, 55 nt, Salmonella enterica enterica serovar Typhi Ty2
caauacgcugaacguguauggaauaucaccgacgguuccgacgacgagcguauug

SEQ ID NO: 4246907 - RNA, 67 nt, Salmonella enterica enterica serovar Typhi Ty2; identical to SEQ ID NO: 4246361

SEQ ID NO: 4246908 - RNA, 76 nt, Salmonella enterica enterica serovar Typhi Ty2; identical to SEQ ID NO: 4245862

SEQ ID NO: 4246909 - RNA, 83 nt, Salmonella enterica enterica serovar Typhi Ty2
ugggcaauacugaaucgccaauggaaguuaauaggaguuggugccauuuuauuagccauuaucggcgcuuugguuaucacuca

SEQ ID NO: 4246910 - RNA, 73 nt, Salmonella enterica enterica serovar Typhi Ty2; identical to SEQ ID NO: 4246443

SEQ ID NO: 4246911 - RNA, 88 nt, Salmonella enterica enterica serovar Typhi Ty2
gacggguaaugcacgcaucgaccgcuuucagguuguccguaccgccaaccgcagcaauauagcuggucgccaguugcguuaacccuuc

SEQ ID NO: 4246912 - RNA, 81 nt, Salmonella enterica enterica serovar Typhi Ty2
ugcguaugcugaugaugagcgcaggcuuuaauaucgaauggucgacguuuauggcuucgcugcuggucggcaguauuggua

SEQ ID NO: 4246913 - RNA, 62 nt, Salmonella enterica enterica serovar Typhi Ty2
uaugugaauggaaaaacguacgaauucuggaagcagaauguugcgcagaucauauucacaug

SEQ ID NO: 4246914 - RNA, 70 nt, Salmonella enterica enterica serovar Typhi Ty2
cgcgcaagagaggguaacagcgugaaauacaauacgaugaauaacgaugagauuauccugucguugugcg

SEQ ID NO: 4246915 - RNA, 67 nt, Salmonella enterica enterica serovar Typhi Ty2
cgcuuuucgcaauugcagauaagcggcaagaucgauacgcgcguuuaucagcuuguugagaagaucg

SEQ ID NO: 4246916 - RNA, 72 nt, Salmonella enterica enterica serovar Typhi Ty2
acgacuaaucaguaccuggugcccacgggacucuaauaaagguagcucauccaggauacgauuaagcgucgu

SEQ ID NO: 4246917 - RNA, 85 nt, Salmonella enterica enterica serovar Typhi Ty2
uggcggugcggagcgauuccggcgugaccagaaacuggagccguccacguuucccgcgcccggacugcgccucccaucuuagcca

SEQ ID NO: 4246918 - RNA, 69 nt, Salmonella enterica enterica serovar Typhi Ty2
aauggucguuaucauccagccagaccucugccugaaaacgcagauaaccggugugauuggcgauccauu

SEQ ID NO: 4246919 - RNA, 82 nt, Salmonella enterica enterica serovar Typhi Ty2; identical to SEQ ID NO: 4246513

SEQ ID NO: 4246920 - RNA, 124 nt, Salmonella enterica enterica serovar Typhi Ty2
auuauuugacgcacagcgucguugcagcgaccuuaacucugccguuuauaaguauuacgacaauauaaagaagcguugucugaacggagaaaaggugccguauucggauuuggacguccuuaau

SEQ ID NO: 4246921 - RNA, 78 nt, Salmonella enterica enterica serovar Typhi Ty2
guaacggcucuauuugcgcacgcagaucauccggcaucggaggacgaugcgauuuguaguguucaaagagcucgucac

SEQ ID NO: 4246922 - RNA, 56 nt, Salmonella enterica enterica serovar Typhi Ty2; identical to SEQ ID NO: 4246240

SEQ ID NO: 4246923 - RNA, 71 nt, Salmonella enterica enterica serovar Typhi Ty2
gugguaauuagugaggauggcgccaguaucagcgacaccgccgaaccggguagcuccauuacgaucaccac

SEQ ID NO: 4246924 - RNA, 77 nt, Salmonella enterica enterica serovar Typhi Ty2
uggucugcgugaagguacgaguaauaacguccugcugcuguucuuucgucagggaguuaaaacguacugcguaacca

SEQ ID NO: 4246925 - RNA, 58 nt, Salmonella enterica enterica serovar Typhi Ty2; identical to SEQ ID NO: 4246486

SEQ ID NO: 4246926 - RNA, 63 nt, Salmonella enterica enterica serovar Typhi Ty2; identical to SEQ ID NO: 4246553

SEQ ID NO: 4246927 - RNA, 57 nt, Salmonella enterica enterica serovar Typhi Ty2; identical to SEQ ID NO: 4246169

SEQ ID NO: 4246928 - RNA, 66 nt, Salmonella enterica enterica serovar Typhi Ty2
guuagggaugguucgacaauggcagcaacuguuuuuccaggagcgauauagcgaaaccacccugac

SEQ ID NO: 4246929 - RNA, 78 nt, Salmonella enterica enterica serovar Typhi Ty2; identical to SEQ ID NO: 4246548

SEQ ID NO: 4246930 - RNA, 63 nt, Salmonella enterica enterica serovar Typhi Ty2
cugcgcaacaugguggcggcgggcagugguauuacacuacuccccgcgcuggccguaccgcag

SEQ ID NO: 4246931 - RNA, 98 nt, Salmonella enterica enterica serovar Typhi Ty2
gguguuggcgggcugguucccaaauuucucuacgacuacuuuccucuugagguucgugguuuggguaccgggcuuauuuauaaucuugcugcgacauc

SEQ ID NO: 4246932 - RNA, 99 nt, Salmonella enterica enterica serovar Typhi Ty2
uuguggucgccaucaugguauggcugaauguccugacauuaaccggcccgguuuuuacgcuguggccggcaggccagccaaccgauacggugacgacga

SEQ ID NO: 4246933 - RNA, 71 nt, Salmonella enterica enterica serovar Typhi Ty2
uguuggucaaaucuacuauuucacggagucucgcaccggcgaugacaacauuaaaugggagaaugacgaca

SEQ ID NO: 4246934 - RNA, 122 nt, Salmonella enterica enterica serovar Typhi Ty2
gcguauauucauuguuuaucauccuuguucguagcuacguuaaggacgugaauacucaagacaaagucuaacguucuguaacguagcuacgggcuauaagauuaucgauaugaauacuaagc

SEQ ID NO: 4246935 - RNA, 61 nt, Salmonella enterica enterica serovar Typhi Ty2; identical to SEQ ID NO: 4246145

SEQ ID NO: 4246936 - RNA, 59 nt, Salmonella enterica enterica serovar Typhi Ty2
guagucgccaauaccgagguagcggguaauuucgcccagcgcuucgguauggcgggugc

SEQ ID NO: 4246937 - RNA, 91 nt, Salmonella enterica enterica serovar Typhi Ty2; identical to SEQ ID NO: 4246603

SEQ ID NO: 4246938 - RNA, 67 nt, Salmonella enterica enterica serovar Typhi Ty2
ggccaccagcgucagaaauaacugaagaguauaggugguuuuuucagccguuuucaggacgcugucc

SEQ ID NO: 4246939 - RNA, 99 nt, Salmonella enterica enterica serovar Typhi Ty2; identical to SEQ ID NO: 4246295

SEQ ID NO: 4246940 - RNA, 79 nt, Salmonella enterica enterica serovar Typhi Ty2; identical to SEQ ID NO: 4246406

SEQ ID NO: 4246941 - RNA, 71 nt, Salmonella enterica enterica serovar Typhi Ty2; identical to SEQ ID NO: 4245749

SEQ ID NO: 4246942 - RNA, 103 nt, Salmonella enterica enterica serovar Typhi Ty2; identical to SEQ ID NO: 4246296

SEQ ID NO: 4246943 - RNA, 64 nt, Salmonella enterica enterica serovar Typhi Ty2; identical to SEQ ID NO: 4246336

SEQ ID NO: 4246944 - RNA, 67 nt, Salmonella enterica enterica serovar Typhi Ty2; identical to SEQ ID NO: 4246647

SEQ ID NO: 4246945 - RNA, 60 nt, Salmonella enterica enterica serovar Typhi Ty2
cugauuacccgggagcaauguuguggauuuuuuauucauacagggcggacggguaguaag

SEQ ID NO: 4246946 - RNA, 57 nt, Salmonella enterica enterica serovar Typhi Ty2; identical to SEQ ID NO: 4245762

SEQ ID NO: 4246947 - RNA, 93 nt, Salmonella enterica enterica serovar Typhi Ty2
aaugagaaagaggaacguuugcccuuuacauuuccaccaaagauucugguuuugucucuuguaaagggcauacguaucgcguuuuaucucauu

SEQ ID NO: 4246948 - RNA, 68 nt, Salmonella enterica enterica serovar Typhi Ty2; identical to SEQ ID NO: 4246081

SEQ ID NO: 4246949 - RNA, 65 nt, Salmonella enterica enterica serovar Typhi Ty2
guguugaaucuuuagcguugagcgauaauacagaaaaaguauuaaccuuuacguuaaagcugcac

SEQ ID NO: 4246950 - RNA, 57 nt, Salmonella enterica enterica serovar Typhi Ty2
uuuucggacucacucagcuuucgagaaauaaucauuaagcugacagaguccugaaaa

SEQ ID NO: 4246951 - RNA, 65 nt, Salmonella enterica enterica serovar Typhi Ty2
cacggcgauuacgugaacgacaaaacauucaaacgccguuuucaacguuggcuuaauacgcugug

SEQ ID NO: 4246952 - RNA, 74 nt, Salmonella enterica enterica serovar Typhi Ty2
agcaguucggcaccgucgaugauuuuggucauggaaaccggaccuuugucaucggcuggcagcacggugaugcu

SEQ ID NO: 4246953 - RNA, 71 nt, Salmonella enterica enterica serovar Typhi Ty2
cuggugccuaaucgcuuugaggacggcuacgguuuaagcccggaaguggucgaucaggcgaaggcgcgcgg

SEQ ID NO: 4246954 - RNA, 59 nt, Salmonella enterica enterica serovar Typhi Ty2
gauauugccguaaaugcuaauggcgucaguggcgauuauuuuaacguuuacggcauguc

SEQ ID NO: 4246955 - RNA, 76 nt, Salmonella enterica enterica serovar Typhi Ty2
ggccaugugccggaugcacuggaugccgcccauuauuguguacugggcgcgccgccagucgccgcagacgcuggcc

SEQ ID NO: 4246956 - RNA, 100 nt, Salmonella enterica enterica serovar Typhi Ty2; identical to SEQ ID NO: 4246376

SEQ ID NO: 4246957 - RNA, 88 nt, Salmonella enterica enterica serovar Typhi Ty2
gaaggucuaaucaaucggaugggcuuuaauaaucugggcgucgauaaccuggucgagaauguuaaaaaagcccauuuugaugguauuc

SEQ ID NO: 4246958 - RNA, 73 nt, Salmonella enterica enterica serovar Typhi Ty2; identical to SEQ ID NO: 4246520

SEQ ID NO: 4246959 - RNA, 80 nt, Salmonella enterica enterica serovar Typhi Ty2; identical to SEQ ID NO: 4246638

SEQ ID NO: 4246960 - RNA, 66 nt, Salmonella enterica enterica serovar Typhi Ty2
gagcugcacuggcguaucacguuagucuuuaccguauuuaugauggcgcugauggucgugccgcuc

SEQ ID NO: 4246961 - RNA, 103 nt, Salmonella enterica enterica serovar Typhi Ty2; identical to SEQ ID NO: 4246729

SEQ ID NO: 4246962 - RNA, 130 nt, Salmonella enterica enterica serovar Typhi Ty2
gcucggcgguuuuuuuaucgaucagauagcccugcgcagcgccggagacgaagacgcccucgcgguaaaacuuuuugucuccgccugcugcggcauacauaucaucaugcagcggcugccaguucacggc

SEQ ID NO: 4246963 - RNA, 79 nt, Salmonella enterica enterica serovar Typhi Ty2
ccgcuuuaccgugacgucgaaaccaucguccgcgugaaugcgcuggacuccgaauggggcgucaacgaucuggaagcgg

SEQ ID NO: 4246964 - RNA, 82 nt, Salmonella enterica enterica serovar Typhi Ty2; identical to SEQ ID NO: 4246362

SEQ ID NO: 4246965 - RNA, 58 nt, Salmonella enterica enterica serovar Typhi Ty2
guagcguaacuucauuaacggcgaaaacaucaauagcgccguuauuguugugcccuac

SEQ ID NO: 4246966 - RNA, 77 nt, Salmonella enterica enterica serovar Typhi Ty2
gagauugugacugcgguacagcagcgcuauccccuuucacuggcggugauugccuguaauaccgccaguacggucuc

SEQ ID NO: 4246967 - RNA, 70 nt, Salmonella enterica enterica serovar Typhi Ty2
ggucaguaugguaagcagcuaucuuuaaauuucuuuacaacaagcguaaagauaagcugcuuuacucccc

SEQ ID NO: 4246968 - RNA, 99 nt, Salmonella enterica enterica serovar Typhi Ty2
gcggcgguuaucauuccugauuuuuccagaugauucagacaggguuccuauacuuaggcuguguaugauucauccggagaggaauaugaccaaagucgc

SEQ ID NO: 4246969 - RNA, 80 nt, Salmonella enterica enterica serovar Typhi Ty2; identical to SEQ ID NO: 4246006

SEQ ID NO: 4246970 - RNA, 55 nt, Salmonella enterica enterica serovar Typhi Ty2; identical to SEQ ID NO: 4245779

SEQ ID NO: 4246971 - RNA, 71 nt, Salmonella enterica enterica serovar Typhi Ty2; identical to SEQ ID NO: 4245804

SEQ ID NO: 4246972 - RNA, 60 nt, Salmonella enterica enterica serovar Typhi Ty2; identical to SEQ ID NO: 4246013

SEQ ID NO: 4246973 - RNA, 70 nt, Salmonella enterica enterica serovar Typhi Ty2
auguuuggacuaacgguagugauuauacgacccaugauuggguugaugaugauacuuuuaaucuaaacau

SEQ ID NO: 4246974 - RNA, 68 nt, Salmonella enterica enterica serovar Typhi Ty2
aucgucacuuuuuuaccgcuguugcugcuguuauuuguggaacgcauuagcguaaaaaaauugaugau

SEQ ID NO: 4246975 - RNA, 74 nt, Salmonella enterica enterica serovar Typhi Ty2; identical to SEQ ID NO: 4246650

SEQ ID NO: 4246976 - RNA, 58 nt, Salmonella enterica enterica serovar Typhi Ty2; identical to SEQ ID NO: 4246741

SEQ ID NO: 4246977 - RNA, 61 nt, Salmonella enterica enterica serovar Typhi Ty2; identical to SEQ ID NO: 4246378

SEQ ID NO: 4246978 - RNA, 57 nt, Salmonella enterica enterica serovar Typhi Ty2; identical to SEQ ID NO: 4246672

SEQ ID NO: 4246979 - RNA, 91 nt, Salmonella enterica enterica serovar Typhi Ty2; identical to SEQ ID NO: 4245765

SEQ ID NO: 4246980 - RNA, 63 nt, Salmonella enterica enterica serovar Typhi Ty2
cugcaggacucugcaacgucugcgauagguaauauuaaaaauacgguuggaggguugcugcag

SEQ ID NO: 4246981 - RNA, 81 nt, Salmonella enterica enterica serovar Typhi Ty2
ccgauuaacgacucgucuaucaccggcauuaaaacgggccugauggggccgcuugccgggaugggcgacucgauuaucugg

SEQ ID NO: 4246982 - RNA, 85 nt, Salmonella enterica enterica serovar Typhi Ty2; identical to SEQ ID NO: 4245866

SEQ ID NO: 4246983 - RNA, 59 nt, Salmonella enterica enterica serovar Typhi Ty2; identical to SEQ ID NO: 4246151

SEQ ID NO: 4246984 - RNA, 62 nt, Salmonella enterica enterica serovar Typhi Ty2; identical to SEQ ID NO: 4245827

SEQ ID NO: 4246985 - RNA, 78 nt, Salmonella enterica enterica serovar Typhi Ty2
gauaaaguacaggauguucggcguaucgugcagaacggcgucugcgcgguuggugccuaauuccauguacgcguuauc

SEQ ID NO: 4246986 - RNA, 66 nt, Salmonella enterica enterica serovar Typhi Ty2; identical to SEQ ID NO: 4246029

SEQ ID NO: 4246987 - RNA, 70 nt, Salmonella enterica enterica serovar Typhi Ty2
cgccuuuuagguugcugcaccgucaugagaacuccugguagucuauauguugugcggcacuuuucgggug

SEQ ID NO: 4246988 - RNA, 66 nt, Salmonella enterica enterica serovar Typhi Ty2
auccgccuguacgcuacagcgguucaucaauuggcgcucaguugggggcgguuguggcagggggau

SEQ ID NO: 4246989 - RNA, 81 nt, Salmonella enterica enterica serovar Typhi Ty2; identical to SEQ ID NO: 4246119

SEQ ID NO: 4246990 - RNA, 63 nt, Salmonella enterica enterica serovar Typhi Ty2
ggcagcaaaaugcugugcguuggccgcggacgucccguuuccacaacagaggauuuuguugcc

SEQ ID NO: 4246991 - RNA, 58 nt, Salmonella enterica enterica serovar Typhi Ty2; identical to SEQ ID NO: 4246477

SEQ ID NO: 4246992 - RNA, 76 nt, Salmonella enterica enterica serovar Typhi Ty2
guccucaaguagcuuccugaugguagugggcgucauuaacaccgacggcaccaugacccaggaggauauuucggau

SEQ ID NO: 4246993 - RNA, 66 nt, Salmonella enterica enterica serovar Typhi Ty2; identical to SEQ ID NO: 4245879

SEQ ID NO: 4246994 - RNA, 66 nt, Salmonella enterica enterica serovar Typhi Ty2; identical to SEQ ID NO: 4246117

SEQ ID NO: 4246995 - RNA, 90 nt, Salmonella enterica enterica serovar Typhi Ty2
uguaggguauagcguaaaaaaaugcccggcuguucagcacguuaacgcauguuacugaacgccgaagcguauuuagagccuaucccacca

SEQ ID NO: 4246996 - RNA, 63 nt, Salmonella enterica enterica serovar Typhi Ty2
gugauuaccguacaaggacauuaaaaugaaaaaaacguugauguuguuagcgauggugguggc

SEQ ID NO: 4246997 - RNA, 60 nt, Salmonella enterica enterica serovar Typhi Ty2; identical to SEQ ID NO: 4246115

SEQ ID NO: 4246998 - RNA, 60 nt, Salmonella enterica enterica serovar Typhi Ty2; identical to SEQ ID NO: 4246742

SEQ ID NO: 4246999 - RNA, 95 nt, Salmonella enterica enterica serovar Typhi Ty2; identical to SEQ ID NO: 4246337

SEQ ID NO: 4247000 - RNA, 57 nt, Salmonella enterica enterica serovar Typhi Ty2
uagcagagcgugcagucccgcgugauugcuguuuccgcauaucugccuguucugcua

SEQ ID NO: 4247001 - RNA, 56 nt, Salmonella enterica enterica serovar Typhi Ty2
auggcugcccggcgccuguaacguauccagccgauuuugcaggccacggcgguuau

SEQ ID NO: 4247002 - RNA, 82 nt, Salmonella enterica enterica serovar Typhi Ty2
accggugcuauacuuauuuucguuaauuaccugggacacaaacaucaagaggauaugagauuaugaguaccgcuaaacuggu

SEQ ID NO: 4247003 - RNA, 58 nt, Salmonella enterica enterica serovar Typhi Ty2; identical to SEQ ID NO: 4246683

SEQ ID NO: 4247004 - RNA, 78 nt, Salmonella enterica enterica serovar Typhi Ty2
gauuauugcaacauagauaugagguucacuaauuuaccuguaagggaaagugaucagcguguuuuuguugcagauauu

SEQ ID NO: 4247005 - RNA, 58 nt, Salmonella enterica enterica serovar Typhi Ty2
guaaucgcugcuaaaggcuucgccgcugcuuugugaaccgaugccuccggugauauac

SEQ ID NO: 4247006 - RNA, 85 nt, Salmonella enterica enterica serovar Typhi Ty2
gcuguuuuaugcgcugugagacggcggauugcgugaugcacagcuucugggcggcgcgcucgaauccucguucacguauaacggc

SEQ ID NO: 4247007 - RNA, 75 nt, Salmonella enterica enterica serovar Typhi Ty2; identical to SEQ ID NO: 4246438

SEQ ID NO: 4247008 - RNA, 61 nt, Salmonella enterica enterica serovar Typhi Ty2
gccugaugacgcugcgcuuauccggccuacgguagacuggguaagcgcagcgccaucaggc

SEQ ID NO: 4247009 - RNA, 80 nt, Salmonella enterica enterica serovar Typhi Ty2; identical to SEQ ID NO: 4246166

SEQ ID NO: 4247010 - RNA, 57 nt, Salmonella enterica enterica serovar Typhi Ty2
ggguggaucggcguuuuauucuuguugagauauucaacaaacgccuugaugccgccu

SEQ ID NO: 4247011 - RNA, 65 nt, Salmonella enterica enterica serovar Typhi Ty2
gaauuugauacugucggcaaugcgcuucgccguuugcggcggaagcucuccgacaauggugauuu

SEQ ID NO: 4247012 - RNA, 71 nt, Salmonella enterica enterica serovar Typhi Ty2; identical to SEQ ID NO: 4246181

SEQ ID NO: 4247013 - RNA, 97 nt, Salmonella enterica enterica serovar Typhi Ty2; identical to SEQ ID NO: 4246673

SEQ ID NO: 4247014 - RNA, 66 nt, Salmonella enterica enterica serovar Typhi Ty2
gccauuggacuugccgggauuauucugcugaacagcggcgguaauuuaagcggcaauccguggggc

SEQ ID NO: 4247015 - RNA, 78 nt, Salmonella enterica enterica serovar Typhi Ty2
gacuucgacgcgcugaauauucugcguccggacagcgagccgcgugcgacgcaccauauucaggaaauuaucgagcuc

SEQ ID NO: 4247016 - RNA, 58 nt, Salmonella enterica enterica serovar Typhi Ty2; identical to SEQ ID NO: 4245875

SEQ ID NO: 4247017 - RNA, 64 nt, Salmonella enterica enterica serovar Typhi Ty2; identical to SEQ ID NO: 4246350

SEQ ID NO: 4247018 - RNA, 65 nt, Salmonella enterica enterica serovar Typhi Ty2
gguacauaucguaaugcgggcgauaccacuccagcauggugaauuccggauuaugaugucguccc

SEQ ID NO: 4247019 - RNA, 74 nt, Salmonella enterica enterica serovar Typhi Ty2; identical to SEQ ID NO: 4246734

SEQ ID NO: 4247020 - RNA, 66 nt, Salmonella enterica enterica serovar Typhi Ty2
gccguuagcgacggcgcugccaaguacgguauugcuacugucgcggauagugaccguugccccggc

SEQ ID NO: 4247021 - RNA, 64 nt, Salmonella enterica enterica serovar Typhi Ty2
gagguugcuauagaauggauuaguauuauuuugugguagugguaaauacauuuauuuuaaccuu

SEQ ID NO: 4247022 - RNA, 106 nt, Salmonella enterica enterica serovar Typhi Ty2
ucgguggugacuuucacauuugacgauuuuaccugaucgcuggucaguagcugugagcgaacuuucguggugauccagguaucguuagaggcgguccccaggccga

SEQ ID NO: 4247023 - RNA, 110 nt, Salmonella enterica enterica serovar Typhi Ty2; identical to SEQ ID NO: 4246276

SEQ ID NO: 4247024 - RNA, 55 nt, Salmonella enterica enterica serovar Typhi Ty2; identical to SEQ ID NO: 4246147

SEQ ID NO: 4247025 - RNA, 116 nt, Salmonella enterica enterica serovar Typhi Ty2; identical to SEQ ID NO: 4246026

SEQ ID NO: 4247026 - RNA, 91 nt, Salmonella enterica enterica serovar Typhi Ty2; identical to SEQ ID NO: 4246493

SEQ ID NO: 4247027 - RNA, 70 nt, Salmonella enterica enterica serovar Typhi Ty2
agcaauggcgcguuauauuugucauaaauucgccaauggcggcgaauuacgagcaguaaugguaucugcu

SEQ ID NO: 4247028 - RNA, 68 nt, Salmonella enterica enterica serovar Typhi Ty2
gcucugguggauaucccucugguauugcauggggcaucugguuugccggaaagcgauauucgccaggc

SEQ ID NO: 4247029 - RNA, 64 nt, Salmonella enterica enterica serovar Typhi Ty2; identical to SEQ ID NO: 4246311

SEQ ID NO: 4247030 - RNA, 55 nt, Salmonella enterica enterica serovar Typhi Ty2; identical to SEQ ID NO: 4245909

SEQ ID NO: 4247031 - RNA, 70 nt, Salmonella enterica enterica serovar Typhi Ty2; identical to SEQ ID NO: 4246704

SEQ ID NO: 4247032 - RNA, 80 nt, Salmonella enterica enterica serovar Typhi Ty2
uuuuccugaugacguuucgcuuaucaggccuacaauguuguucgaaccguaggccugaaagcggcgcgucaucaggcagg

SEQ ID NO: 4247033 - RNA, 58 nt, Salmonella enterica enterica serovar Typhi Ty2
auucgcgguaauuaaccgucugcuuaaacagguagaugaggugguaauugccacggau

SEQ ID NO: 4247034 - RNA, 60 nt, Salmonella enterica enterica serovar Typhi Ty2; identical to SEQ ID NO: 4246644

SEQ ID NO: 4247035 - RNA, 63 nt, Salmonella enterica enterica serovar Typhi Ty2; identical to SEQ ID NO: 4245906

SEQ ID NO: 4247036 - RNA, 82 nt, Salmonella enterica enterica serovar Typhi Ty2; identical to SEQ ID NO: 4246167

SEQ ID NO: 4247037 - RNA, 101 nt, Salmonella enterica enterica serovar Typhi Ty2; identical to SEQ ID NO: 4245776

SEQ ID NO: 4247038 - RNA, 80 nt, Salmonella enterica enterica serovar Typhi Ty2; identical to SEQ ID NO: 4245868

SEQ ID NO: 4247039 - RNA, 90 nt, Salmonella enterica enterica serovar Typhi Ty2; identical to SEQ ID NO: 4246257

SEQ ID NO: 4247040 - RNA, 83 nt, Salmonella enterica enterica serovar Typhi Ty2
ggcggaacgcagcgacuucagugccaguacuguaagaaggucuggacgccaaaacagcacgcgcugaaugucgccgaaacgcc

SEQ ID NO: 4247041 - RNA, 64 nt, Salmonella enterica enterica serovar Typhi Ty2
acgggcggguuaagcgcggaagauggacggcgcaucgccuuucauauccgcuuuaaucgcgcgu

SEQ ID NO: 4247042 - RNA, 77 nt, Salmonella enterica enterica serovar Typhi Ty2
uacugucaacggcauaggugugguccugggaaaucgccaacguauagccagugaggacgcuaaugccgcuggcggua

SEQ ID NO: 4247043 - RNA, 56 nt, Salmonella enterica enterica serovar Typhi Ty2
gcgaucguggugcuggcgcagaucagccgcugguaugcagcccagcaccggauagc

SEQ ID NO: 4247044 - RNA, 75 nt, Salmonella enterica enterica serovar Typhi Ty2
gccugcacuaaaucagcggcggacgcgcugcccaucaccagcgcagugcguuccgccagguuuacccgugccugc

SEQ ID NO: 4247045 - RNA, 72 nt, Salmonella enterica enterica serovar Typhi Ty2
ugccgguugauagugucuuauucggcaauugauaugacuuaaaaauuaauuccguaagcauuucagacggua

SEQ ID NO: 4247046 - RNA, 57 nt, Salmonella enterica enterica serovar Typhi Ty2
ggagauaucuucgcacaugcuuguaaugauaauuacauuuauuccgaagauauguuu

SEQ ID NO: 4247047 - RNA, 82 nt, Salmonella enterica enterica serovar Typhi Ty2; identical to SEQ ID NO: 4246602

SEQ ID NO: 4247048 - RNA, 62 nt, Salmonella enterica enterica serovar Typhi Ty2
gcuguagcgacucuucgccggugacguacagcguuuucaucugcucggcaaguuugcacagc

SEQ ID NO: 4247049 - RNA, 123 nt, Salmonella enterica enterica serovar Typhi Ty2
gagcgguaauacugugccggauggcggcugcgccuuauccggccuacaagauuugcaauaucaguauauugcgauaaauucuuguaggccugauaaacgcagcgccaucgggcauuaccucuu

SEQ ID NO: 4247050 - RNA, 76 nt, Salmonella enterica enterica serovar Typhi Ty2; identical to SEQ ID NO: 4245960

SEQ ID NO: 4247051 - RNA, 123 nt, Salmonella enterica enterica serovar Typhi Ty2
gcgcgaugagccggguaugcgcuuguuccauuuaucuuuccugacgacgggucuguaggcaguauacuaccaccacgcguggaaaugauguaccggaccaaugcccuuccccacuuccagcgu

SEQ ID NO: 4247052 - RNA, 91 nt, Salmonella enterica enterica serovar Typhi Ty2
uguauuauugccauuaguuaaagaagccaauauugacccgauuuauuucggcgucauguucauuauuaacugcucuauuggauuaaucaca

SEQ ID NO: 4247053 - RNA, 59 nt, Salmonella enterica enterica serovar Typhi Ty2
uucgcuaucguuauucugguuucccucuauccggguaagcugcuggauacgguagggaa

SEQ ID NO: 4247054 - RNA, 56 nt, Salmonella enterica enterica serovar Typhi Ty2; identical to SEQ ID NO: 4246692

SEQ ID NO: 4247055 - RNA, 57 nt, Salmonella enterica enterica serovar Typhi Ty2; identical to SEQ ID NO: 4246557

SEQ ID NO: 4247056 - RNA, 65 nt, Salmonella enterica enterica serovar Typhi Ty2
ggguacugagugguggaccgugggcguacguccaauguacaaguggacgccaaucaugaguaccc

SEQ ID NO: 4247057 - RNA, 60 nt, Salmonella enterica enterica serovar Typhi Ty2; identical to SEQ ID NO: 4246355

SEQ ID NO: 4247058 - RNA, 57 nt, Salmonella enterica enterica serovar Typhi Ty2
ccaauggucauagcggcagcgccagcgcuagcuggcaggcgacguauggcacgcugg

SEQ ID NO: 4247059 - RNA, 66 nt, Salmonella enterica enterica serovar Typhi Ty2; identical to SEQ ID NO: 4246174

SEQ ID NO: 4247060 - RNA, 82 nt, Salmonella enterica enterica serovar Typhi Ty2; identical to SEQ ID NO: 4245789

SEQ ID NO: 4247061 - RNA, 66 nt, Salmonella enterica enterica serovar Typhi Ty2; identical to SEQ ID NO: 4246612

SEQ ID NO: 4247062 - RNA, 113 nt, Salmonella enterica enterica serovar Typhi Ty2
ggcgugugcugcugcgcuaccacuuccggcccugcaugccagauaaccuucccgcucucuuuauccacggcaaugacgccggaagugguacgcaggcucaucaguaccaggcc

SEQ ID NO: 4247063 - RNA, 56 nt, Salmonella enterica enterica serovar Typhi Ty2; identical to SEQ ID NO: 4246177

SEQ ID NO: 4247064 - RNA, 90 nt, Salmonella enterica enterica serovar Typhi Ty2
ggauuaaacggcugggcgugaauaccgcgguguucccugucucagauaaaggcgucgauaccacguguauucaccuuccugagaaaaucc

SEQ ID NO: 4247065 - RNA, 59 nt, Salmonella enterica enterica serovar Typhi Ty2
guacugauguauacgcuggccuauuuuugccuuaccaauacgcuuagcgccauuaguau

SEQ ID NO: 4247066 - RNA, 70 nt, Salmonella enterica enterica serovar Typhi Ty2
uauccaaugguuaacguucuggcguuuauucucgcuccaggggccuguaaucaauuaauugucuuggaua

SEQ ID NO: 4247067 - RNA, 65 nt, Salmonella enterica enterica serovar Typhi Ty2
uggcgauucgcuauggcuacuaccguuacgaaaccgaagugaugguuguuaccguaguggcgcug

SEQ ID NO: 4247068 - RNA, 84 nt, Salmonella enterica enterica serovar Typhi Ty2
caugaugaugacugaauugaggcaucgagauaugcgacuggccggccagucgucuuuugacgaugcccaauacaaaacaugaug

SEQ ID NO: 4247069 - RNA, 57 nt, Salmonella enterica enterica serovar Typhi Ty2
gaccaacuuuauguccaauaccgcaacgacagcgcuauuggugccggugaguuuguc

SEQ ID NO: 4247070 - RNA, 97 nt, Salmonella enterica enterica serovar Typhi Ty2; identical to SEQ ID NO: 4246071

SEQ ID NO: 4247071 - RNA, 56 nt, Salmonella enterica enterica serovar Typhi Ty2; identical to SEQ ID NO: 4246499

SEQ ID NO: 4247072 - RNA, 72 nt, Salmonella enterica enterica serovar Typhi Ty2
gguuacgcuaaucuuauaagucccugcggcagcgccugcgguaguacugacuuugagguccucugucgugcu

SEQ ID NO: 4247073 - RNA, 65 nt, Salmonella enterica enterica serovar Typhi Ty2
uggcggcaccuuccagaacgaaaucaccgaacguaacgugaugggcguuccggcgguguuuguca

SEQ ID NO: 4247074 - RNA, 69 nt, Salmonella enterica enterica serovar Typhi Ty2; identical to SEQ ID NO: 4245922

SEQ ID NO: 4247075 - RNA, 100 nt, Salmonella enterica enterica serovar Typhi Ty2
cgguugcggcuggugaaguucgcccgguaggucgaugcggagugcugguuaggcgucugcauccccacgcgggugacaaaguucucguagccgucggccg

SEQ ID NO: 4247076 - RNA, 69 nt, Salmonella enterica enterica serovar Typhi Ty2
cagugcggucugccgaagaaaauggcgcuggagcuguucaaaccguucaucuacggcaaacuggaacug

SEQ ID NO: 4247077 - RNA, 94 nt, Salmonella enterica enterica serovar Typhi Ty2; identical to SEQ ID NO: 4246052

SEQ ID NO: 4247078 - RNA, 122 nt, Salmonella enterica enterica serovar Typhi Ty2; identical to SEQ ID NO: 4245886

SEQ ID NO: 4247079 - RNA, 73 nt, Salmonella enterica enterica serovar Typhi Ty2; identical to SEQ ID NO: 4245813

SEQ ID NO: 4247080 - RNA, 64 nt, Salmonella enterica enterica serovar Typhi Ty2; identical to SEQ ID NO: 4246435

SEQ ID NO: 4247081 - RNA, 90 nt, Salmonella enterica enterica serovar Typhi Ty2
aucgcggcguuuuauggcagcauuaugggcauuaaguuuucuauuaagcuuaaugguauccaucaugcgguacauaaugcggaccccgau

SEQ ID NO: 4247082 - RNA, 67 nt, Salmonella enterica enterica serovar Typhi Ty2; identical to SEQ ID NO: 4246226

SEQ ID NO: 4247083 - RNA, 95 nt, Salmonella enterica enterica serovar Typhi Ty2
cgccuauuaccaccugacgaucgucguugcaggcgugcgccaguugggcaacauggcguucgcuacaauggccgguaaacugcagauguuuugcg

SEQ ID NO: 4247084 - RNA, 83 nt, Salmonella enterica enterica serovar Typhi Ty2; identical to SEQ ID NO: 4246460

SEQ ID NO: 4247085 - RNA, 59 nt, Salmonella enterica enterica serovar Typhi Ty2; identical to SEQ ID NO: 4245870

SEQ ID NO: 4247086 - RNA, 60 nt, Salmonella enterica enterica serovar Typhi Ty2; identical to SEQ ID NO: 4246178

SEQ ID NO: 4247087 - RNA, 90 nt, Salmonella enterica enterica serovar Typhi Ty2; identical to SEQ ID NO: 4246064

SEQ ID NO: 4247088 - RNA, 67 nt, Salmonella enterica enterica serovar Typhi Ty2
ggccugaucacgcuugcggugaugguuuuugcgggcggucacuuuuaccguaacgcguggaaaagcc

SEQ ID NO: 4247089 - RNA, 73 nt, Salmonella enterica enterica serovar Typhi Ty2; identical to SEQ ID NO: 4245920

SEQ ID NO: 4247090 - RNA, 56 nt, Salmonella enterica enterica serovar Typhi Ty2
uuucgcgggcuucugccauaauguuuaugggaugugagaacggaggccgcgugaga

SEQ ID NO: 4247091 - RNA, 55 nt, Salmonella enterica enterica serovar Typhi Ty2
ccguuaguccugcucugugacagggauauuuuuaucugcagggcaguaacagcgg

SEQ ID NO: 4247092 - RNA, 59 nt, Salmonella enterica enterica serovar Typhi Ty2; identical to SEQ ID NO: 4246263

SEQ ID NO: 4247093 - RNA, 84 nt, Salmonella enterica enterica serovar Typhi Ty2
cugcguaccacuuccggcgucauugccguggauaaagagagcgggaagguuaucuggcaugcagggccggaagugguagcgcag

SEQ ID NO: 4247094 - RNA, 116 nt, Salmonella enterica enterica serovar Typhi Ty2; identical to SEQ ID NO: 4246183

SEQ ID NO: 4247095 - RNA, 59 nt, Salmonella enterica enterica serovar Typhi Ty2
cgcgauggcuuucauuuccagccccgugccgguuugauugggaaugaagccaaucugcg

SEQ ID NO: 4247096 - RNA, 62 nt, Salmonella enterica enterica serovar Typhi Ty2; identical to SEQ ID NO: 4246680

SEQ ID NO: 4247097 - RNA, 83 nt, Salmonella enterica enterica serovar Typhi Ty2; identical to SEQ ID NO: 4246400

SEQ ID NO: 4247098 - RNA, 75 nt, Salmonella enterica enterica serovar Typhi Ty2; identical to SEQ ID NO: 4246751

SEQ ID NO: 4247099 - RNA, 65 nt, Salmonella enterica enterica serovar Typhi Ty2; identical to SEQ ID NO: 4246215

SEQ ID NO: 4247100 - RNA, 117 nt, Salmonella enterica enterica serovar Typhi Ty2; identical to SEQ ID NO: 4246213

SEQ ID NO: 4247101 - RNA, 103 nt, Salmonella enterica enterica serovar Typhi Ty2; identical to SEQ ID NO: 4245810

SEQ ID NO: 4247102 - RNA, 75 nt, Salmonella enterica enterica serovar Typhi Ty2
auugagauugauuuaggcgacuccggucugcguuaccagccgggcgaugcgcugggcgucugguaucagaacgau

SEQ ID NO: 4247103 - RNA, 69 nt, Salmonella enterica enterica serovar Typhi Ty2; identical to SEQ ID NO: 4246464

SEQ ID NO: 4247104 - RNA, 84 nt, Salmonella enterica enterica serovar Typhi Ty2; identical to SEQ ID NO: 4246702

SEQ ID NO: 4247105 - RNA, 127 nt, Salmonella enterica enterica serovar Typhi Ty2; identical to SEQ ID NO: 4246289

SEQ ID NO: 4247106 - RNA, 115 nt, Salmonella enterica enterica serovar Typhi Ty2
guucauacugcuuagccauaccagaccagaaugcaguagucgcugcggaggugauaguaauaccacgcuccugcuccugcuccauccaguccaugguagcugcgccgucaugaac

SEQ ID NO: 4247107 - RNA, 56 nt, Salmonella enterica enterica serovar Typhi Ty2; identical to SEQ ID NO: 4246309

SEQ ID NO: 4247108 - RNA, 55 nt, Salmonella enterica enterica serovar Typhi Ty2
uccggcauuugcgcggcgaccguuucggcauucgguucgccgauguacagccggg

SEQ ID NO: 4247109 - RNA, 97 nt, Salmonella enterica enterica serovar Typhi Ty2
cgucuuacagcguugcugcgugguaguguagguaucacucuccugcauugaucccuggauuugauugccagcauaaccgccgcccagcgccccgacg

SEQ ID NO: 4247110 - RNA, 56 nt, Salmonella enterica enterica serovar Typhi Ty2
ugguucugacguaucccuguguaauagagcguauccaggacagugagccagaacca

SEQ ID NO: 4247111 - RNA, 66 nt, Salmonella enterica enterica serovar Typhi Ty2; identical to SEQ ID NO: 4245928

SEQ ID NO: 4247112 - RNA, 64 nt, Salmonella enterica enterica serovar Typhi Ty2; identical to SEQ ID NO: 4245874

SEQ ID NO: 4247113 - RNA, 64 nt, Salmonella enterica enterica serovar Typhi Ty2; identical to SEQ ID NO: 4246576

SEQ ID NO: 4247114 - RNA, 72 nt, Salmonella enterica enterica serovar Typhi Ty2; identical to SEQ ID NO: 4245929

SEQ ID NO: 4247115 - RNA, 65 nt, Salmonella enterica enterica serovar Typhi Ty2; identical to SEQ ID NO: 4246242

SEQ ID NO: 4247116 - RNA, 77 nt, Salmonella enterica enterica serovar Typhi Ty2; identical to SEQ ID NO: 4245756

SEQ ID NO: 4247117 - RNA, 62 nt, Salmonella enterica enterica serovar Typhi Ty2
gguugaucugcgaggcggucacgcccaguaccaggcgcgcauuuucgaccucgacaaucacc

SEQ ID NO: 4247118 - RNA, 74 nt, Salmonella enterica enterica serovar Typhi Ty2
gcguuaucucggcaugucgauggguaucggcaucgcuaucggcauuacgcuuaucgucggcacgcugaugacgc

SEQ ID NO: 4247119 - RNA, 61 nt, Salmonella enterica enterica serovar Typhi Ty2
uaaugagcugaugaaugaacuaaaaaaagagcuuggguugguucagggcguuaucuuguua

SEQ ID NO: 4247120 - RNA, 55 nt, Salmonella enterica enterica serovar Typhi Ty2
cgggcaguuaauggcgacgcugaaccaaacgaaagugucguuguugacucgccug

SEQ ID NO: 4247121 - RNA, 129 nt, Salmonella enterica enterica serovar Typhi Ty2; identical to SEQ ID NO: 4246675

SEQ ID NO: 4247122 - RNA, 67 nt, Salmonella enterica enterica serovar Typhi Ty2; identical to SEQ ID NO: 4245760

SEQ ID NO: 4247123 - RNA, 101 nt, Salmonella enterica enterica serovar Typhi Ty2; identical to SEQ ID NO: 4246625

SEQ ID NO: 4247124 - RNA, 112 nt, Salmonella enterica enterica serovar Typhi Ty2
uuagcggugauccccgcgcuggcguuggugccuuuauuggcgggaucggccgacgagcauuucgacugguuuaaaguggcaaugaagguacuggcuuucgcgguaaugcuga

SEQ ID NO: 4247125 - RNA, 56 nt, Salmonella enterica enterica serovar Typhi Ty2; identical to SEQ ID NO: 4246318

SEQ ID NO: 4247126 - RNA, 83 nt, Salmonella enterica enterica serovar Typhi Ty2
ggcgcgagagugguuccgccaugaaacgcggcgcguggcgcccauuacgcuggacgucaugugggaucauuuuuuaucgcgcc

SEQ ID NO: 4247127 - RNA, 116 nt, Salmonella enterica enterica serovar Typhi Ty2
ugauuugccugguguggguucgauuccugcuacugucugauaauuguuggguuaguuucuucuugauaggguaucagcagggcaggcuuucgaaauuugacauccagcaagaaucg

SEQ ID NO: 4247128 - RNA, 84 nt, Salmonella enterica enterica serovar Typhi Ty2
gcaggcgcuggcucguucguugaacgugaugaucuucuccgauaaugucacgcuggacgacgaaaucagacuaaaacgccgggc

SEQ ID NO: 4247129 - RNA, 78 nt, Salmonella enterica enterica serovar Typhi Ty2; identical to SEQ ID NO: 4246583

SEQ ID NO: 4247130 - RNA, 66 nt, Salmonella enterica enterica serovar Typhi Ty2
gguguaucugcgguauuuaauccauauguggauacuccgcuuugagguauuaaucuguaggugacc

SEQ ID NO: 4247131 - RNA, 62 nt, Salmonella enterica enterica serovar Typhi Ty2
gcuggccauuaucgcuacaggcguagaugauuucucggcuuucgccucgguaguggcuacgc

SEQ ID NO: 4247132 - RNA, 57 nt, Salmonella enterica enterica serovar Typhi Ty2
uuaccgcuaugccgaugaacauaauaucuuuucgguucgucugccugauagcgguga

SEQ ID NO: 4247133 - RNA, 64 nt, Salmonella enterica enterica serovar Typhi Ty2
ccggagcagcuucuugcuggccgaaacgguaggaaacaccuacgcucagcaggccguuguccgg

SEQ ID NO: 4247134 - RNA, 88 nt, Salmonella enterica enterica serovar Typhi Ty2
ccuggcaagcugcuggcugcgccuuucgcuucaguguaucuggaagaggaugcgcuggugaugggaaaggcgacgcuggagauacggg

SEQ ID NO: 4247135 - RNA, 59 nt, Salmonella enterica enterica serovar Typhi Ty2
aagugcggcaauacuaucgcugcgcaauggaucgcguaccgccaguaacgccgccgcuu

SEQ ID NO: 4247136 - RNA, 86 nt, Salmonella enterica enterica serovar Typhi Ty2; identical to SEQ ID NO: 4246142

SEQ ID NO: 4247137 - RNA, 62 nt, Salmonella enterica enterica serovar Typhi Ty2; identical to SEQ ID NO: 4246611

SEQ ID NO: 4247138 - RNA, 66 nt, Salmonella enterica enterica serovar Typhi Ty2
agcucaccacugcacgaaaaugauucauugcuuuaaucaacucccgcuuuucgucaguggucagcu

SEQ ID NO: 4247139 - RNA, 84 nt, Salmonella enterica enterica serovar Typhi Ty2
cgggucuaugaugaguacgcauuuguuggccggauaagaugcuuugcaucaugcacuucggcucaaaugcgucauuguuccccg

SEQ ID NO: 4247140 - RNA, 82 nt, Salmonella enterica enterica serovar Typhi Ty2
cgccuaauugaugccgcgucgcuuagugauuaucgucgccagacggggcuggucacccaggaugucgcauuauuuagcggcg

SEQ ID NO: 4247141 - RNA, 97 nt, Salmonella enterica enterica serovar Typhi Ty2; identical to SEQ ID NO: 4245787

SEQ ID NO: 4247142 - RNA, 62 nt, Salmonella enterica enterica serovar Typhi Ty2; identical to SEQ ID NO: 4246566

SEQ ID NO: 4247143 - RNA, 129 nt, Salmonella enterica enterica serovar Typhi Ty2
acgcaagagguaaugcccgauggcgcugcguuuaucaggccuacaagaauuuaucgcaauauacugauauugcaaaucuuguaggccggauaaggcgcagccgccauccggcacaguauuaccgcucgu

SEQ ID NO: 4247144 - RNA, 81 nt, Salmonella enterica enterica serovar Typhi Ty2; identical to SEQ ID NO: 4246125

SEQ ID NO: 4247145 - RNA, 128 nt, Salmonella enterica enterica serovar Typhi Ty2; identical to SEQ ID NO: 4246594

SEQ ID NO: 4247146 - RNA, 63 nt, Salmonella enterica enterica serovar Typhi Ty2
gccagauauauuuuccugcaucaauaccguaaaggagugaagcaugaaacgauauauacuggc

SEQ ID NO: 4247147 - RNA, 66 nt, Salmonella enterica enterica serovar Typhi Ty2
ucaucgcuucggcaucaaagguaucggcagaaauaaccuuguugaucugcuuugccgaaaucauga

SEQ ID NO: 4247148 - RNA, 97 nt, Salmonella enterica enterica serovar Typhi Ty2
ucauguuugacaggcagucaauauuuauucauggaaugaaaaucaguuugcagcagcacauuccaggaauaaguauccagagugucggucaggcaga

SEQ ID NO: 4247149 - RNA, 92 nt, Salmonella enterica enterica serovar Typhi Ty2
cugccugaaguggauauuauccggauggauagacucaaggucagggaacgcuuugagacuaacgccaggauagaacaggccgcggcaggcag

SEQ ID NO: 4247150 - RNA, 65 nt, Salmonella enterica enterica serovar Typhi Ty2; identical to SEQ ID NO: 4246453

SEQ ID NO: 4247151 - RNA, 55 nt, Salmonella enterica enterica serovar Typhi Ty2; identical to SEQ ID NO: 4245752

SEQ ID NO: 4247152 - RNA, 77 nt, Salmonella enterica enterica serovar Typhi Ty2
cgcggcaaucgguuuuugcagaaucgucuccggcaguucaaaacgcgccagaucgucugcgaaggcugucggcugcg

SEQ ID NO: 4247153 - RNA, 81 nt, Salmonella enterica enterica serovar Typhi Ty2; identical to SEQ ID NO: 4246593

SEQ ID NO: 4247154 - RNA, 60 nt, Salmonella enterica enterica serovar Typhi Ty2; identical to SEQ ID NO: 4246550

SEQ ID NO: 4247155 - RNA, 55 nt, Salmonella enterica enterica serovar Typhi Ty2; identical to SEQ ID NO: 4246231

SEQ ID NO: 4247156 - RNA, 89 nt, Salmonella enterica enterica serovar Typhi Ty2
gcccgccccggccacauuuccuacguuaucgagccgguggaacggcuguagcgccagauggauguguucauuaucaaugccggggccgc

SEQ ID NO: 4247157 - RNA, 124 nt, Salmonella enterica enterica serovar Typhi Ty2; identical to SEQ ID NO: 4246277

SEQ ID NO: 4247158 - RNA, 78 nt, Salmonella enterica enterica serovar Typhi Ty2
ggcuaaccauuccuguuuuucgucugucaguggcaacccgauaagggaacagcuggcgguugaaagacggggaaugcc

SEQ ID NO: 4247159 - RNA, 93 nt, Salmonella enterica enterica serovar Typhi Ty2
gcuaauacucgcuuagugccggaaagacggcagcgccauccggcacgccaucgccugauggcgcuacgcuuaucaggccugugacguuaacgc

SEQ ID NO: 4247160 - RNA, 55 nt, Salmonella enterica enterica serovar Typhi Ty2; identical to SEQ ID NO: 4245972

SEQ ID NO: 4247161 - RNA, 69 nt, Salmonella enterica enterica serovar Typhi Ty2
gccgcgguauugagcgauaaaccaaucaucgccgccgggauaggguccagcucaauaccaaauugcggc

SEQ ID NO: 4247162 - RNA, 129 nt, Salmonella enterica enterica serovar Typhi Ty2; identical to SEQ ID NO: 4246374

SEQ ID NO: 4247163 - RNA, 67 nt, Salmonella enterica enterica serovar Typhi Ty2
gcguuucgaugagguuuguugcaacgguuaaaucagacagaccuuccagcagacacucuuccagcgu

SEQ ID NO: 4247164 - RNA, 61 nt, Salmonella enterica enterica serovar Typhi Ty2; identical to SEQ ID NO: 4246135

SEQ ID NO: 4247165 - RNA, 79 nt, Salmonella enterica enterica serovar Typhi Ty2; identical to SEQ ID NO: 4246099

SEQ ID NO: 4247166 - RNA, 60 nt, Salmonella enterica enterica serovar Typhi Ty2
uaaggaucggugacuuugucauuaauugguauacgaccaauuaaugccgucaucgccuua

SEQ ID NO: 4247167 - RNA, 64 nt, Salmonella enterica enterica serovar Typhi Ty2
ggccgcugauaucaaugcuggcgaguguuuccagcccaaugccgccuugcgcaauaucauugcc

SEQ ID NO: 4247168 - RNA, 79 nt, Salmonella enterica enterica serovar Typhi Ty2; identical to SEQ ID NO: 4245750

SEQ ID NO: 4247169 - RNA, 127 nt, Salmonella enterica enterica serovar Typhi Ty2; identical to SEQ ID NO: 4246587

SEQ ID NO: 4247170 - RNA, 72 nt, Salmonella enterica enterica serovar Typhi Ty2
guaggccggauaaggcgaagcugccauccggcggugcagguugccugauggcgcugcgcuuaucaggccuac

SEQ ID NO: 4247171 - RNA, 75 nt, Salmonella enterica enterica serovar Typhi Ty2
cgaugaugcacaucggcauccauucaccgucugcgcaauacuucgcuaucgcuaugcugcugauguucaucauug

SEQ ID NO: 4247172 - RNA, 82 nt, Salmonella enterica enterica serovar Typhi Ty2
cgcuggaaaaaacuggauaauuuuauugaucguccgguaaaacuaauuauuggcgacaaagaaauauuugguauuucccgcg

SEQ ID NO: 4247173 - RNA, 79 nt, Salmonella enterica enterica serovar Typhi Ty2
gcgggcguuuggguaauguaugguauugaugguuaugucgugacauccgcgauugaucaucaugcugccucuaacccgc

SEQ ID NO: 4247174 - RNA, 90 nt, Salmonella enterica enterica serovar Typhi Ty2; identical to SEQ ID NO: 4246292

SEQ ID NO: 4247175 - RNA, 62 nt, Salmonella enterica enterica serovar Typhi Ty2; identical to SEQ ID NO: 4246085

SEQ ID NO: 4247176 - RNA, 67 nt, Salmonella enterica enterica serovar Typhi Ty2
cuggaccaggccaaugacauaagggauggccagcgcgcugcgcucgccuuugucguuggccggccag

SEQ ID NO: 4247177 - RNA, 58 nt, Salmonella enterica enterica serovar Typhi Ty2; identical to SEQ ID NO: 4246487

SEQ ID NO: 4247178 - RNA, 69 nt, Salmonella enterica enterica serovar Typhi Ty2; identical to SEQ ID NO: 4245816

SEQ ID NO: 4247179 - RNA, 78 nt, Salmonella enterica enterica serovar Typhi Ty2
gauuuggugaauuacauugacguuggcgcaaucuauuauuucaacaaaaauauguccgcguuuguagauuacaaaauc

SEQ ID NO: 4247180 - RNA, 114 nt, Salmonella enterica enterica serovar Typhi Ty2
gcauugugccgaacuugccguaggccggauaaggcggagccgccauccggcggugcagguugccugauggcgcugcgcuuaucaggccuacauuuuuacaguuaccacacaugc

SEQ ID NO: 4247181 - RNA, 63 nt, Salmonella enterica enterica serovar Typhi Ty2
cguuggauaaagacaauuucgaauaccacuauccgcgugguuuugacgauugcuuuaccauug

SEQ ID NO: 4247182 - RNA, 59 nt, Salmonella enterica enterica serovar Typhi Ty2; identical to SEQ ID NO: 4246529

SEQ ID NO: 4247183 - RNA, 69 nt, Salmonella enterica enterica serovar Typhi Ty2
auguuacuggcgugcugaagacguuacaggaaggaguagguauagaauguuuggcuaucgcaguaacgu

SEQ ID NO: 4247184 - RNA, 67 nt, Salmonella enterica enterica serovar Typhi Ty2; identical to SEQ ID NO: 4246033

SEQ ID NO: 4247185 - RNA, 61 nt, Salmonella enterica enterica serovar Typhi Ty2
uaggcugagucccccaaagguucgcgagacgugacgaugcgccauggcgggacacagucua

SEQ ID NO: 4247186 - RNA, 60 nt, Salmonella enterica enterica serovar Typhi Ty2
ggcgcugcuggggcaaaacgagacgguggugaacggucuugucucgccgaccggcacgcc

SEQ ID NO: 4247187 - RNA, 77 nt, Salmonella enterica enterica serovar Typhi Ty2
uucaggccuuaccuggcaugggcgacgaggcgcugugcuaugcgcugagccguuaucuguuaugccagcagccugag

SEQ ID NO: 4247188 - RNA, 65 nt, Salmonella enterica enterica serovar Typhi Ty2; identical to SEQ ID NO: 4246454

SEQ ID NO: 4247189 - RNA, 58 nt, Salmonella enterica enterica serovar Typhi Ty2
ccugcgcuuuugccagaucgcccuuagcgcugucguaagucgccugguaagucgcagg

SEQ ID NO: 4247190 - RNA, 95 nt, Salmonella enterica enterica serovar Typhi Ty2
ggcauuccugcgccugcguuaugaugaugaugucuuuauugucggaguacauauucugauucaaauugagcgucuuauccgggcagagggaugcu

SEQ ID NO: 4247191 - RNA, 58 nt, Salmonella enterica enterica serovar Typhi Ty2
guugucauuuggacaacagugauuuccgcaugggaaaucauugcugccggauggcggc

SEQ ID NO: 4247192 - RNA, 56 nt, Salmonella enterica enterica serovar Typhi Ty2; identical to SEQ ID NO: 4246313

SEQ ID NO: 4247193 - RNA, 65 nt, Salmonella enterica enterica serovar Typhi Ty2; identical to SEQ ID NO: 4246241

SEQ ID NO: 4247194 - RNA, 64 nt, Salmonella enterica enterica serovar Typhi Ty2; identical to SEQ ID NO: 4246045

SEQ ID NO: 4247195 - RNA, 80 nt, Salmonella enterica enterica serovar Typhi Ty2
gccgcuaucgguuuugaggugauuaaaaucauuaugacuuauacgcugccgucacuggugaaaucgccuuccggcgcggc

SEQ ID NO: 4247196 - RNA, 63 nt, Salmonella enterica enterica serovar Typhi Ty2
ccguaccgucaauaucagcuuucgcgucggcggcaggcuggcgucgcugaauguugaugaagg

SEQ ID NO: 4247197 - RNA, 66 nt, Salmonella enterica enterica serovar Typhi Ty2
ucuuuacuuuuugugguaugguuuaaacauccucguggaggaucaacuaucgcaaacaagaaaaga

SEQ ID NO: 4247198 - RNA, 65 nt, Salmonella enterica enterica serovar Typhi Ty2; identical to SEQ ID NO: 4246591

SEQ ID NO: 4247199 - RNA, 68 nt, Salmonella enterica enterica serovar Typhi Ty2
gucauccguaugguaaccgcgcuuuugcauaaguuuuucauguagcgcgaggaacuguugcggaugau

SEQ ID NO: 4247200 - RNA, 64 nt, Salmonella enterica enterica serovar Typhi Ty2
gcuucacguuucuccuccauuugacugucgguuccugaccaguauggaggagauagcgacaggu

SEQ ID NO: 4247201 - RNA, 86 nt, Salmonella enterica enterica serovar Typhi Ty2; identical to SEQ ID NO: 4246686

SEQ ID NO: 4247202 - RNA, 72 nt, Salmonella enterica enterica serovar Typhi Ty2
gaagaaucgacgcagcgucugaauguuauuauccgcgauaauugacucacgcgcuugcgcgaguuucucuuc

SEQ ID NO: 4247203 - RNA, 81 nt, Salmonella enterica enterica serovar Typhi Ty2; identical to SEQ ID NO: 4246554

SEQ ID NO: 4247204 - RNA, 89 nt, Salmonella enterica enterica serovar Typhi Ty2
ucaguggaugacggcccgcaauauugccuuuguggugguaaacaucaauauaaauuaccgucgcccggcgguauugagcgaucuacuga

SEQ ID NO: 4247205 - RNA, 65 nt, Salmonella enterica enterica serovar Typhi Ty2
agacugaugacuaaccuucugccugauaaacgcgcgccaucacgcagaaaguuugcuaucagucu

SEQ ID NO: 4247206 - RNA, 67 nt, Salmonella enterica enterica serovar Typhi Ty2; identical to SEQ ID NO: 4246588

SEQ ID NO: 4247207 - RNA, 55 nt, Salmonella enterica enterica serovar Typhi Ty2; identical to SEQ ID NO: 4246601

SEQ ID NO: 4247208 - RNA, 71 nt, Salmonella enterica enterica serovar Typhi Ty2; identical to SEQ ID NO: 4245955

SEQ ID NO: 4247209 - RNA, 70 nt, Salmonella enterica enterica serovar Typhi Ty2
cuuuagccuguggaauggcggucagauccgcacacucaucuggggucuuugcugcuuuccacaacugagg

SEQ ID NO: 4247210 - RNA, 95 nt, Salmonella enterica enterica serovar Typhi Ty2; identical to SEQ ID NO: 4246661

SEQ ID NO: 4247211 - RNA, 66 nt, Salmonella enterica enterica serovar Typhi Ty2
acgguagaaacugcuugguauuuuuaccgucagcguaguaggaaaccagcguuuuccccacgccgu

SEQ ID NO: 4247212 - RNA, 67 nt, Salmonella enterica enterica serovar Typhi Ty2; identical to SEQ ID NO: 4245993

SEQ ID NO: 4247213 - RNA, 55 nt, Salmonella enterica enterica serovar Typhi Ty2
ggcuaauugcgguaucuuuuacacgcaccugcaaauucaggugccgggauuagcc

SEQ ID NO: 4247214 - RNA, 55 nt, Salmonella enterica enterica serovar Typhi Ty2
cccggcaugggcggcguuugcauuaugggaucggcggacgcugcccacgucuggg

SEQ ID NO: 4247215 - RNA, 69 nt, Salmonella enterica enterica serovar Typhi Ty2
uuccucgauaaagguaaauuguggcaccugccggagcagcuaacgcagguucgcuggguuuaccuggaa

SEQ ID NO: 4247216 - RNA, 55 nt, Salmonella enterica enterica serovar Typhi Ty2; identical to SEQ ID NO: 4246695

SEQ ID NO: 4247217 - RNA, 76 nt, Salmonella enterica enterica serovar Typhi Ty2
gaugauccagaucccgcguaucggccaggaagugcugguggauuucaaaaacggcgauccggaucugccgaucauc

SEQ ID NO: 4247218 - RNA, 79 nt, Salmonella enterica enterica serovar Typhi Ty2
cgucauuccugcgcgguagcuuucgucagaucgcucagcauaauauugagcuucuucugcaaggcuuccgaacaugucg

SEQ ID NO: 4247219 - RNA, 85 nt, Salmonella enterica enterica serovar Typhi Ty2
auccuccgcagacgcgguauuaaugcucacccuaguaccuucaucaucgcuggcuuuagcagguaaugccgcuuuggcggaggau

SEQ ID NO: 4247220 - RNA, 70 nt, Salmonella enterica enterica serovar Typhi Ty2
gaagaggugauucgcuggaaugcgcaaacggucgccgcccgucugcgcgugcuggcggaugacauucuuu

SEQ ID NO: 4247221 - RNA, 126 nt, Salmonella enterica enterica serovar Typhi Ty2; identical to SEQ ID NO: 4246204

SEQ ID NO: 4247222 - RNA, 60 nt, Salmonella enterica enterica serovar Typhi Ty2
cgcuguauuaccaggaagagcucaaucucaaagagauuggcgcgguacuggaagucggcg

SEQ ID NO: 4247223 - RNA, 56 nt, Salmonella enterica enterica serovar Typhi Ty2; identical to SEQ ID NO: 4246605

SEQ ID NO: 4247224 - RNA, 55 nt, Salmonella enterica enterica serovar Typhi Ty2
cgcguugucauccagcgacuggcuauuaauuuccagcgcuuucguuaacaacgcg

SEQ ID NO: 4247225 - RNA, 66 nt, Salmonella enterica enterica serovar Typhi Ty2
ccgggcaacgggcgaaaaucgccgaaaaagugcuaaaagagaucggcgaucgccucaaguuucugg

SEQ ID NO: 4247226 - RNA, 101 nt, Salmonella enterica enterica serovar Typhi Ty2; identical to SEQ ID NO: 4246046

SEQ ID NO: 4247227 - RNA, 58 nt, Salmonella enterica enterica serovar Typhi Ty2
ugagaaucaauccaacccgcgcuaacguaacauucgccgcgcaggucaaugguuuuca

SEQ ID NO: 4247228 - RNA, 81 nt, Salmonella enterica enterica serovar Typhi Ty2
ucgucauuaugucuaucuauccguggaaucaggucggcacaaacggcagcccauuugugcugacguuccagcauaugggga

SEQ ID NO: 4247229 - RNA, 74 nt, Salmonella enterica enterica serovar Typhi Ty2
ccgggguaucuguuuauucuucgucagaugcguuuucugcauuggcgacgauaaaucgguucaucuucgccugg

SEQ ID NO: 4247230 - RNA, 58 nt, Salmonella enterica enterica serovar Typhi Ty2
gggcauggcgcagccaggcuggcagcguuguccgcacggccuguuucuugccgugccu

SEQ ID NO: 4247231 - RNA, 68 nt, Salmonella enterica enterica serovar Typhi Ty2; identical to SEQ ID NO: 4246096

SEQ ID NO: 4247232 - RNA, 100 nt, Salmonella enterica enterica serovar Typhi Ty2
gcguucauugucaucgaccaccagccacucaaagccguaagcaucgaaauccagcucaugcaacgcuuuaugguggcgauaggugugguugagaucgcgc

SEQ ID NO: 4247233 - RNA, 122 nt, Salmonella enterica enterica serovar Typhi Ty2
cgggagcgcguugcgauguggcgcaacugagcaauauuguggcgauggcgggcaucggucauccgccgcgcuuuuucgccacgcuggaagccuguggcgcgcauccgcaaaagugcgucccg

SEQ ID NO: 4247234 - RNA, 70 nt, Salmonella enterica enterica serovar Typhi Ty2; identical to SEQ ID NO: 4246641

SEQ ID NO: 4247235 - RNA, 66 nt, Salmonella enterica enterica serovar Typhi Ty2; identical to SEQ ID NO: 4246347

SEQ ID NO: 4247236 - RNA, 71 nt, Salmonella enterica enterica serovar Typhi Ty2; identical to SEQ ID NO: 4227861

SEQ ID NO: 4247237 - RNA, 66 nt, Salmonella enterica enterica serovar Typhi Ty2; identical to SEQ ID NO: 4246595

SEQ ID NO: 4247238 - RNA, 65 nt, Salmonella enterica enterica serovar Typhi Ty2; identical to SEQ ID NO: 4245950

SEQ ID NO: 4247239 - RNA, 60 nt, Salmonella enterica enterica serovar Typhi Ty2; identical to SEQ ID NO: 4246101

SEQ ID NO: 4247240 - RNA, 84 nt, Salmonella enterica enterica serovar Typhi Ty2; identical to SEQ ID NO: 4245916

SEQ ID NO: 4247241 - RNA, 81 nt, Salmonella enterica enterica serovar Typhi Ty2
cgcgaagggcugaaaaaucguuauggcgcuuugaugcaaaccauuuccggcguacauuacaauuuuucauuaccgauggcg

SEQ ID NO: 4247242 - RNA, 60 nt, Salmonella enterica enterica serovar Typhi Ty2; identical to SEQ ID NO: 4246196

SEQ ID NO: 4247243 - RNA, 69 nt, Salmonella enterica enterica serovar Typhi Ty2
ggccgucuuuaacgagguacugggcgaguacaaaaaucagcuguucauuacccgugaugaagaugcgcc

SEQ ID NO: 4247244 - RNA, 63 nt, Salmonella enterica enterica serovar Typhi Ty2; identical to SEQ ID NO: 4246192

SEQ ID NO: 4247245 - RNA, 81 nt, Salmonella enterica enterica serovar Typhi Ty2; identical to SEQ ID NO: 4246108

SEQ ID NO: 4247246 - RNA, 57 nt, Salmonella enterica enterica serovar Typhi Ty2
ucaggcuacguucggugagcuccaacauaagcguuaucguucccaaacgaguccuga

SEQ ID NO: 4247247 - RNA, 80 nt, Salmonella enterica enterica serovar Typhi Ty2; identical to SEQ ID NO: 4246344

SEQ ID NO: 4247248 - RNA, 88 nt, Salmonella enterica enterica serovar Typhi Ty2
uaaaagacggcauaagagauaaagaccgaggcgauaaucucaaaacgaaauuuuuuauaggucuggucuaucucuuuuuucucuuuua

SEQ ID NO: 4247249 - RNA, 73 nt, Salmonella enterica enterica serovar Typhi Ty2
ggucauuggcccucccaucagaccuaucagacuauuaaaugcaucccagauuucugauucaucggccaugacc

SEQ ID NO: 4247250 - RNA, 86 nt, Salmonella enterica enterica serovar Typhi Ty2
uggcggccgcgcgcgacgcaaagaguacuggauguuuauucuggucaauaucaucuuuaccuuuguguugggccugcuggacgcca

SEQ ID NO: 4247251 - RNA, 62 nt, Salmonella enterica enterica serovar Typhi Ty2; identical to SEQ ID NO: 4246065

SEQ ID NO: 4247252 - RNA, 78 nt, Salmonella enterica enterica serovar Typhi Ty2; identical to SEQ ID NO: 4246139

SEQ ID NO: 4247253 - RNA, 79 nt, Salmonella enterica enterica serovar Typhi Ty2; identical to SEQ ID NO: 4246191

SEQ ID NO: 4247254 - RNA, 57 nt, Salmonella enterica enterica serovar Typhi Ty2; identical to SEQ ID NO: 4246073

SEQ ID NO: 4247255 - RNA, 58 nt, Salmonella enterica enterica serovar Typhi Ty2; identical to SEQ ID NO: 4246363

SEQ ID NO: 4247256 - RNA, 103 nt, Salmonella enterica enterica serovar Typhi Ty2; identical to SEQ ID NO: 4245973

SEQ ID NO: 4247257 - RNA, 82 nt, Salmonella enterica enterica serovar Typhi Ty2; identical to SEQ ID NO: 4246414

SEQ ID NO: 4247258 - RNA, 61 nt, Salmonella enterica enterica serovar Typhi Ty2
guauuucagguggccuucacgcuguaauaccggaacgcuggcguagggcacaaugaaaugc

SEQ ID NO: 4247259 - RNA, 107 nt, Salmonella enterica enterica serovar Typhi Ty2
cguuaaaaggguggcuugcguucuauugcaccaauguggugcuuaauguucacauugaagcacuauuuuggugcaacauagucaccguggugcagcccuuuugcacg

SEQ ID NO: 4247260 - RNA, 56 nt, Salmonella enterica enterica serovar Typhi Ty2
gagcuggucgacagugcgcuggcuuaucguaucccgcguauuauuuuuaccaguuc

SEQ ID NO: 4247261 - RNA, 70 nt, Salmonella enterica enterica serovar Typhi Ty2; identical to SEQ ID NO: 4246341

SEQ ID NO: 4247262 - RNA, 94 nt, Salmonella enterica enterica serovar Typhi Ty2
ggcgcacuggauacggaauuuuccauuggugguacugagcugcugcuguuuaagcagaugggcaaagccacgguggauggcauccagcugcgcu

SEQ ID NO: 4247263 - RNA, 58 nt, Salmonella enterica enterica serovar Typhi Ty2; identical to SEQ ID NO: 4245825

SEQ ID NO: 4247264 - RNA, 55 nt, Salmonella enterica enterica serovar Typhi Ty2; identical to SEQ ID NO: 4245923

SEQ ID NO: 4247265 - RNA, 66 nt, Salmonella enterica enterica serovar Typhi Ty2; identical to SEQ ID NO: 4246670

SEQ ID NO: 4247266 - RNA, 64 nt, Salmonella enterica enterica serovar Typhi Ty2; identical to SEQ ID NO: 4246564

SEQ ID NO: 4247267 - RNA, 58 nt, Salmonella enterica enterica serovar Typhi Ty2
acagcgaggcaccaucauugaaauguuuaacauguucucugguggugcucucagccgu

SEQ ID NO: 4247268 - RNA, 63 nt, Salmonella enterica enterica serovar Typhi Ty2
gagcaugcucuugcaaacuggguuccggcggaggaggcggcgcucaucagcgcggguauguuc

SEQ ID NO: 4247269 - RNA, 56 nt, Salmonella enterica enterica serovar Typhi Ty2; identical to SEQ ID NO: 4246431

SEQ ID NO: 4247270 - RNA, 63 nt, Salmonella enterica enterica serovar Typhi Ty2; identical to SEQ ID NO: 4246690

SEQ ID NO: 4247271 - RNA, 77 nt, Salmonella enterica enterica serovar Typhi Ty2; identical to SEQ ID NO: 4245888

SEQ ID NO: 4247272 - RNA, 56 nt, Salmonella enterica enterica serovar Typhi Ty2
uuccugaguuuaucggucgucugccagugguggcgacgcugaacgaacucagcgaa

SEQ ID NO: 4247273 - RNA, 58 nt, Salmonella enterica enterica serovar Typhi Ty2
gcuaauaaaaacagggcuggcaggcuauuucggacuugccagccuuuuuuuguauagc

SEQ ID NO: 4247274 - RNA, 62 nt, Salmonella enterica enterica serovar Typhi Ty2
cugguuccguaccggucaucgcgacaucgaaaaacugggcgguauugguaaacggaugccgg

SEQ ID NO: 4247275 - RNA, 59 nt, Salmonella enterica enterica serovar Typhi Ty2; identical to SEQ ID NO: 4245821

SEQ ID NO: 4247276 - RNA, 65 nt, Salmonella enterica enterica serovar Typhi Ty2
gcaggguagacauuagcucgccguggcugaccaguucaucggucagggcugccgaugucgccagc

SEQ ID NO: 4247277 - RNA, 66 nt, Salmonella enterica enterica serovar Typhi Ty2; identical to SEQ ID NO: 4245967

SEQ ID NO: 4247278 - RNA, 61 nt, Salmonella enterica enterica serovar Typhi Ty2
gccugauggcgcugcgcuuacccagucuaccguaggccggauaagcgcagcgucaucaggc

SEQ ID NO: 4247279 - RNA, 78 nt, Salmonella enterica enterica serovar Typhi Ty2; identical to SEQ ID NO: 4246574

SEQ ID NO: 4247280 - RNA, 59 nt, Salmonella enterica enterica serovar Typhi Ty2
gccgaucucuaccugcgcguacggccuggcucagacggcgcgcuggcgcuggggauggc

SEQ ID NO: 4247281 - RNA, 58 nt, Salmonella enterica enterica serovar Typhi Ty2
accggauucacauaggcguagcuggucgccagcgccggacugacguugcgaaucaggu

SEQ ID NO: 4247282 - RNA, 85 nt, Salmonella enterica enterica serovar Typhi Ty2
acugcugauuaaaauccuuguucaacagccgcaaucugccguuguuguuccguaagaaggauaauaauguauuaaaucaguaagu

SEQ ID NO: 4247283 - RNA, 78 nt, Salmonella enterica enterica serovar Typhi Ty2; identical to SEQ ID NO: 4246581

SEQ ID NO: 4247284 - RNA, 96 nt, Salmonella enterica enterica serovar Typhi Ty2; identical to SEQ ID NO: 4246155

SEQ ID NO: 4247285 - RNA, 62 nt, Salmonella enterica enterica serovar Typhi Ty2
uccgguugauaaacgagcgccugauguaacgauuccgucaggcuugcgugagucuggccggg

SEQ ID NO: 4247286 - RNA, 74 nt, Salmonella enterica enterica serovar Typhi Ty2; identical to SEQ ID NO: 4246312

SEQ ID NO: 4247287 - RNA, 56 nt, Salmonella enterica enterica serovar Typhi Ty2
uuucgguaauggcgugcgaaaaaucaauaaauccuuuuggcagucguuuaucggaa

SEQ ID NO: 4247288 - RNA, 75 nt, Salmonella enterica enterica serovar Typhi Ty2; identical to SEQ ID NO: 4246538

SEQ ID NO: 4247289 - RNA, 63 nt, Salmonella enterica enterica serovar Typhi Ty2
cgccgugaagcgauucgcgaaucacugcucgacgaagcccagggcgcggauugcuuaauggug

SEQ ID NO: 4247290 - RNA, 66 nt, Salmonella enterica enterica serovar Typhi Ty2
ccagcagcaggaugccgaaagcccguuaaugauugaugaaagccgcuuucaggccuccuggugugg

SEQ ID NO: 4247291 - RNA, 57 nt, Salmonella enterica enterica serovar Typhi Ty2; identical to SEQ ID NO: 4246436

SEQ ID NO: 4247292 - RNA, 56 nt, Salmonella enterica enterica serovar Typhi Ty2
augguguguuucaucgcuuuucccgcuuauuuacgucaaggucagaaacacacuau

SEQ ID NO: 4247293 - RNA, 63 nt, Salmonella enterica enterica serovar Typhi Ty2
gaacaguuuaaaaagugcauucguucgugaaaccaguuugaggaaugcgcugaaaaaacguuu

SEQ ID NO: 4247294 - RNA, 88 nt, Salmonella enterica enterica serovar Typhi Ty2
gcuuugcgccagcgcguuaaccagcacaucgcguuuuuuccgguaaaaaucggguaacgcgcgauaguguuccggcgcggcgcgcagc

SEQ ID NO: 4247295 - RNA, 123 nt, Salmonella enterica enterica serovar Typhi Ty2
gaagaugagcgcccaaucggccgucugcuggucgacgccugcuacagcccuguagagcguauugccuacaauguugaagcagcgcguguagaacagcguaccgaccuggacaagcuggucauc

SEQ ID NO: 4247296 - RNA, 60 nt, Salmonella enterica enterica serovar Typhi Ty2
cgcgccgguauggucgaggagugaaccgagcgugguacgcucaauccccauaucgcugcg

SEQ ID NO: 4247297 - RNA, 60 nt, Salmonella enterica enterica serovar Typhi Ty2
ucgccaguucccggaaucauugauuacugcauaauuuaucgaugcucccggcguuggcga

SEQ ID NO: 4247298 - RNA, 67 nt, Salmonella enterica enterica serovar Typhi Ty2; identical to SEQ ID NO: 4245943

SEQ ID NO: 4247299 - RNA, 85 nt, Salmonella enterica enterica serovar Typhi Ty2
uugugguuaucaacaagguugaccguccuggcgcgcgcccugacuggguugucgaccagguauucgaccuguuuguuaaccucga

SEQ ID NO: 4247300 - RNA, 83 nt, Salmonella enterica enterica serovar Typhi Ty2
cgcucauguuagcagacaaaucguuguugaagugagaguagcuuaaguuaccgucaacaaagauguuguuugcgaaacgagcg

SEQ ID NO: 4247301 - RNA, 72 nt, Salmonella enterica enterica serovar Typhi Ty2; identical to SEQ ID NO: 4246290

SEQ ID NO: 4247302 - RNA, 79 nt, Salmonella enterica enterica serovar Typhi Ty2; identical to SEQ ID NO: 4245926

SEQ ID NO: 4247303 - RNA, 56 nt, Salmonella enterica enterica serovar Typhi Ty2; identical to SEQ ID NO: 4246693

SEQ ID NO: 4247304 - RNA, 55 nt, Salmonella enterica enterica serovar Typhi Ty2
gccuggauuuaaugcgucgcaggacuaucuguuugccgaucauuuacaucccggu

SEQ ID NO: 4247305 - RNA, 89 nt, Salmonella enterica enterica serovar Typhi Ty2; identical to SEQ ID NO: 4246150

SEQ ID NO: 4247306 - RNA, 67 nt, Salmonella enterica enterica serovar Typhi Ty2; identical to SEQ ID NO: 4246110

SEQ ID NO: 4247307 - RNA, 119 nt, Salmonella enterica enterica serovar Typhi Ty2; identical to SEQ ID NO: 4246122

SEQ ID NO: 4247308 - RNA, 60 nt, Salmonella enterica enterica serovar Typhi Ty2
gcgcagugaggacauauuuguucuacguugccacguuuuacaaaaugaucuuuauugagc

SEQ ID NO: 4247309 - RNA, 67 nt, Salmonella enterica enterica serovar Typhi Ty2; identical to SEQ ID NO: 4246305

SEQ ID NO: 4247310 - RNA, 78 nt, Salmonella enterica enterica serovar Typhi Ty2; identical to SEQ ID NO: 4246120

SEQ ID NO: 4247311 - RNA, 68 nt, Salmonella enterica enterica serovar Typhi Ty2; identical to SEQ ID NO: 4245931

SEQ ID NO: 4247312 - RNA, 61 nt, Salmonella enterica enterica serovar Typhi Ty2; identical to SEQ ID NO: 4246141

SEQ ID NO: 4247313 - RNA, 70 nt, Salmonella enterica enterica serovar Typhi Ty2; identical to SEQ ID NO: 4245939

SEQ ID NO: 4247314 - RNA, 56 nt, Salmonella enterica enterica serovar Typhi Ty2; identical to SEQ ID NO: 4246685

SEQ ID NO: 4247315 - RNA, 73 nt, Salmonella enterica enterica serovar Typhi Ty2; identical to SEQ ID NO: 4246230

SEQ ID NO: 4247316 - RNA, 61 nt, Salmonella enterica enterica serovar Typhi Ty2; identical to SEQ ID NO: 4245894

SEQ ID NO: 4247317 - RNA, 76 nt, Salmonella enterica enterica serovar Typhi Ty2; identical to SEQ ID NO: 4246539

SEQ ID NO: 4247318 - RNA, 73 nt, Salmonella enterica enterica serovar Typhi Ty2; identical to SEQ ID NO: 4245767

SEQ ID NO: 4247319 - RNA, 92 nt, Salmonella enterica enterica serovar Typhi Ty2; identical to SEQ ID NO: 4246395

SEQ ID NO: 4247320 - RNA, 77 nt, Salmonella enterica enterica serovar Typhi Ty2; identical to SEQ ID NO: 4245890

SEQ ID NO: 4247321 - RNA, 80 nt, Salmonella enterica enterica serovar Typhi Ty2; identical to SEQ ID NO: 4246123

SEQ ID NO: 4247322 - RNA, 83 nt, Salmonella enterica enterica serovar Typhi Ty2
uaucccgcagcgaccuguuuguugccggguugcaggaaaucuucuucggugaccggcgugccgacgggcgucacgcggcgaua

SEQ ID NO: 4247323 - RNA, 82 nt, Salmonella enterica enterica serovar Typhi Ty2
cuucgugacaagcagcucauugguaauaauucuuacgaccagauucgugcgacguuaaugacaaugauugagugggaugaag

SEQ ID NO: 4247324 - RNA, 76 nt, Salmonella enterica enterica serovar Typhi Ty2
cuguaccgggaucuggcuaaaaucugaaggcggcacuaacguaugcgucgauuucuggugcgguaccgguaaacag

SEQ ID NO: 4247325 - RNA, 73 nt, Salmonella enterica enterica serovar Typhi Ty2
ccugucagcguauggcugcaagacgguacaggaggcgaucacuuaccgugaaaacuucagccagcgcgaaggg

SEQ ID NO: 4247326 - RNA, 55 nt, Salmonella enterica enterica serovar Typhi Ty2
gguggucggcguccagguuggauuggcgcguuuauccgaaauggucgucaccauc

SEQ ID NO: 4247327 - RNA, 101 nt, Salmonella enterica enterica serovar Typhi Ty2; identical to SEQ ID NO: 4246572

SEQ ID NO: 4247328 - RNA, 74 nt, Salmonella enterica enterica serovar Typhi Ty2; identical to SEQ ID NO: 4246365

SEQ ID NO: 4247329 - RNA, 90 nt, Salmonella enterica enterica serovar Typhi Ty2; identical to SEQ ID NO: 4246267

SEQ ID NO: 4247330 - RNA, 59 nt, Salmonella enterica enterica serovar Typhi Ty2; identical to SEQ ID NO: 4246171

SEQ ID NO: 4247331 - RNA, 58 nt, Salmonella enterica enterica serovar Typhi Ty2
uaagaggcggguagucuagugccggggcguucccgcugcaaccguuacccgcuuuuug

SEQ ID NO: 4247332 - RNA, 120 nt, Salmonella enterica enterica serovar Typhi Ty2; identical to SEQ ID NO: 4246731

SEQ ID NO: 4247333 - RNA, 57 nt, Salmonella enterica enterica serovar Typhi Ty2; identical to SEQ ID NO: 4246197

SEQ ID NO: 4247334 - RNA, 105 nt, Salmonella enterica enterica serovar Typhi Ty2; identical to SEQ ID NO: 4246330

SEQ ID NO: 4247335 - RNA, 88 nt, Salmonella enterica enterica serovar Typhi Ty2; identical to SEQ ID NO: 4246131

SEQ ID NO: 4247336 - RNA, 117 nt, Salmonella enterica enterica serovar Typhi Ty2
cagcgcgccggguuucguaaacugcaugggauagccgauuuuuuccggauucggaugguaaagccggaucgaguggcgaucgccuaucaccacauagucaaaauccgucccgcgcug

SEQ ID NO: 4247337 - RNA, 70 nt, Salmonella enterica enterica serovar Typhi Ty2
ccguggaacggccacaguaccagcgaauguuucugcauuucuugcgcgguggcuuggccgauuucaucgg

SEQ ID NO: 4247338 - RNA, 61 nt, Salmonella enterica enterica serovar Typhi Ty2
ugacguuccagcgcccacuguuguaaccguuccagcagugucccgguggccgcugacguca

SEQ ID NO: 4247339 - RNA, 58 nt, Salmonella enterica enterica serovar Typhi Ty2; identical to SEQ ID NO: 4246053

SEQ ID NO: 4247340 - RNA, 58 nt, Salmonella enterica enterica serovar Typhi Ty2; identical to SEQ ID NO: 4245823

SEQ ID NO: 4247341 - RNA, 76 nt, Salmonella enterica enterica serovar Typhi Ty2; identical to SEQ ID NO: 4246733

SEQ ID NO: 4247342 - RNA, 60 nt, Salmonella enterica enterica serovar Typhi Ty2
ggcugccgauuuugcggcagcggaaaaacuauauccgcaaaugccggaaaaaggcaagcc

SEQ ID NO: 4247343 - RNA, 83 nt, Salmonella enterica enterica serovar Typhi Ty2
accuuacccggcguauugguacaacgcccuuucgugcacuucaugccgaacagguuauuguugcuacgcgccaguuuagaggu

SEQ ID NO: 4247344 - RNA, 87 nt, Salmonella enterica enterica serovar Typhi Ty2
gccauucuggcggaaaucgcagguaucguuuccuucgguaaagaaaccaaaggcaaacgucgccuagugauuacgccgguugauggu

SEQ ID NO: 4247345 - RNA, 65 nt, Salmonella enterica enterica serovar Typhi Ty2
uauccggguaauguaaaaaaucucuaugccauauggcaccagauucauguaugauugccggguua

SEQ ID NO: 4247346 - RNA, 80 nt, Salmonella enterica enterica serovar Typhi Ty2
gguagacggcgggagggguaggcaaaagacgcagaauggaaagcgccgucacgcuuuuuccugacccugacucgccgacc

SEQ ID NO: 4247347 - RNA, 66 nt, Salmonella enterica enterica serovar Typhi Ty2
acaucguaccgauagcaucgggccgcaugacuuacguuuuacuuugcucgaugacuaucugcaugu

SEQ ID NO: 4247348 - RNA, 57 nt, Salmonella enterica enterica serovar Typhi Ty2; identical to SEQ ID NO: 4246481

SEQ ID NO: 4247349 - RNA, 77 nt, Salmonella enterica enterica serovar Typhi Ty2
cuggcgauauagguggcguaaaauccgaacaagaaaaaaucaaacuguucaaggaaauugccgcuugucacgcgcag

SEQ ID NO: 4247350 - RNA, 57 nt, Salmonella enterica enterica serovar Typhi Ty2
gcuuaauuuacggcuuccugucggugaaaaccucgccaccagaccaguaaauuaagu

SEQ ID NO: 4247351 - RNA, 55 nt, Salmonella enterica enterica serovar Typhi Ty2; identical to SEQ ID NO: 4246441

SEQ ID NO: 4247352 - RNA, 105 nt, Salmonella enterica enterica serovar Typhi Ty2
agggcaaaauacuuuuuagcaucauguuuacucuacuggccguaggcgcgcuguucggcgcguuauucauauggcuauuaggguagacggguuaucacugcgccu

SEQ ID NO: 4247353 - RNA, 104 nt, Salmonella enterica enterica serovar Typhi Ty2
gguacgcgcauuuuuucagaugcggcuucagguuaauuuccgcucggaagagagugagauuccugaugcugaaccguuugaauuagagggauugacgcgauauc

SEQ ID NO: 4247354 - RNA, 61 nt, Salmonella enterica enterica serovar Typhi Ty2
gguaaauaaggguucuggaaaaagcgguauuguuaucguuaauccgcagcccugguuugcc

SEQ ID NO: 4247355 - RNA, 67 nt, Salmonella enterica enterica serovar Typhi Ty2
gcuccgacugggugaggcggcuacgcuuagcgcuaucgccagccagacgcuguuaccuaagucgggc

SEQ ID NO: 4247356 - RNA, 62 nt, Salmonella enterica enterica serovar Typhi Ty2
gaucccgcgacgacccguucgauucuggaauugcugaaagauaucaaccgucgucugggguu

SEQ ID NO: 4247357 - RNA, 82 nt, Salmonella enterica enterica serovar Typhi Ty2; identical to SEQ ID NO: 4246328

SEQ ID NO: 4247358 - RNA, 67 nt, Salmonella enterica enterica serovar Typhi Ty2; identical to SEQ ID NO: 4246370

SEQ ID NO: 4247359 - RNA, 66 nt, Salmonella enterica enterica serovar Typhi Ty2
gccgauaaagucgugguuacccgcccuggcggcgaacaggggaaagaggugaucgacgguuacggc

SEQ ID NO: 4247360 - RNA, 70 nt, Salmonella enterica enterica serovar Typhi Ty2
gccguggccgguugccgacgagcaggcaaugguggaaaacaccacgcugguugucgugcagguuaacggu

SEQ ID NO: 4247361 - RNA, 115 nt, Salmonella enterica enterica serovar Typhi Ty2
cguaacacugugcaaaacguugcucauauauugcugaguugacgccggaccacggcagcaaaugcagcgcuggcucaagcucaguuaucugauucaccgucucaacaacauaacg

SEQ ID NO: 4247362 - RNA, 61 nt, Salmonella enterica enterica serovar Typhi Ty2
agaugaugaagggcgcgaucaguugcaggcuaugccaaaagcgacgcgcucuucgauguuu

SEQ ID NO: 4247363 - RNA, 82 nt, Salmonella enterica enterica serovar Typhi Ty2; identical to SEQ ID NO: 4246269

SEQ ID NO: 4247364 - RNA, 60 nt, Salmonella enterica enterica serovar Typhi Ty2; identical to SEQ ID NO: 4246405

SEQ ID NO: 4247365 - RNA, 80 nt, Salmonella enterica enterica serovar Typhi Ty2; identical to SEQ ID NO: 4246407

SEQ ID NO: 4247366 - RNA, 110 nt, Salmonella enterica enterica serovar Typhi Ty2
accagaccagcggguauuccagaccuuucgauuuaugaauggugacgauuugcaccagaugcuuaucgcuuuccagacguaguugcuggcuggaagcauugcuaucaggu

SEQ ID NO: 4247367 - RNA, 128 nt, Salmonella enterica enterica serovar Typhi Ty2; identical to SEQ ID NO: 4245999

SEQ ID NO: 4247368 - RNA, 76 nt, Salmonella enterica enterica serovar Typhi Ty2
aaugccucaauuccguagcuugagcacguuggcgugaaacgacaaugcggcccaagcagcggacugaucaggcguu

SEQ ID NO: 4247369 - RNA, 81 nt, Salmonella enterica enterica serovar Typhi Ty2
gcccgauggcgcugcgcuuaucaggccuacauccguugaggaucuguaggccggauaagacgcgucgcgucgcuauccggc

SEQ ID NO: 4247370 - RNA, 67 nt, Salmonella enterica enterica serovar Typhi Ty2; identical to SEQ ID NO: 4246618

SEQ ID NO: 4247371 - RNA, 77 nt, Salmonella enterica enterica serovar Typhi Ty2; identical to SEQ ID NO: 4246398

SEQ ID NO: 4247372 - RNA, 76 nt, Salmonella enterica enterica serovar Typhi Ty2
guauggcgaaguuuuacucucuuacgggcgucaggugauauuccuggcguuggcuaagggguaaaaaaugcuuuac

SEQ ID NO: 4247373 - RNA, 88 nt, Salmonella enterica enterica serovar Typhi Ty2
gcuugccgccauuuugucgccacuaccaaagaaaaaggggcuacguuuucacguaacccauuguuuuauuuggugggcuggcgggagu

SEQ ID NO: 4247374 - RNA, 77 nt, Salmonella enterica enterica serovar Typhi Ty2
aauugaauguggcgagguguaagaaagcagaaaagcaaaguggguucucguugcucugcaugucgucaaauucaauu

SEQ ID NO: 4247375 - RNA, 115 nt, Salmonella enterica enterica serovar Typhi Ty2; identical to SEQ ID NO: 4246708

SEQ ID NO: 4247376 - RNA, 82 nt, Salmonella enterica enterica serovar Typhi Ty2
ucgccaaauugccccacguacgguuucacuucuacguuguguaacggguagugugagauggugcgaugcuguaagaaaaaga

SEQ ID NO: 4247377 - RNA, 96 nt, Salmonella enterica enterica serovar Typhi Ty2; identical to SEQ ID NO: 4246476

SEQ ID NO: 4247378 - RNA, 88 nt, Salmonella enterica enterica serovar Typhi Ty2; identical to SEQ ID NO: 4246578

SEQ ID NO: 4247379 - RNA, 78 nt, Salmonella enterica enterica serovar Typhi Ty2
uggugagccuacgcgauaccagcuugaacuacguuuacguucgcguaguggaaugcaggccugguaugaguggcacua

SEQ ID NO: 4247380 - RNA, 85 nt, Salmonella enterica enterica serovar Typhi Ty2; identical to SEQ ID NO: 4246156

SEQ ID NO: 4247381 - RNA, 74 nt, Salmonella enterica enterica serovar Typhi Ty2; identical to SEQ ID NO: 4246022

SEQ ID NO: 4247382 - RNA, 57 nt, Salmonella enterica enterica serovar Typhi Ty2; identical to SEQ ID NO: 4246148

SEQ ID NO: 4247383 - RNA, 63 nt, Salmonella enterica enterica serovar Typhi Ty2
gagguuguagugcgacucguauaccucggucaggcugccguugagaucguacugcagcagcuc

SEQ ID NO: 4247384 - RNA, 77 nt, Salmonella enterica enterica serovar Typhi Ty2
gauucuggcgcugccugcggaugaaaaaccacguccuguugacgaugaguuucaacugcgcggcacgcucauugauc

SEQ ID NO: 4247385 - RNA, 82 nt, Salmonella enterica enterica serovar Typhi Ty2
gguguuuuucgaucagcgggaaacagagcguggcgccaggaucggucgccagcacuaccguuccuuuggcgagaaaaacgcc

SEQ ID NO: 4247386 - RNA, 66 nt, Salmonella enterica enterica serovar Typhi Ty2; identical to SEQ ID NO: 4246543

SEQ ID NO: 4247387 - RNA, 57 nt, Salmonella enterica enterica serovar Typhi Ty2
cggccaggcguguucaaggcgggcuuuuacggaacccugcggugaaucgucuucucg

SEQ ID NO: 4247388 - RNA, 80 nt, Salmonella enterica enterica serovar Typhi Ty2
guggaaacggugugagccuccuggaacucgcucauauugaugguuaccagguucugcucaccgccguagauagccuccgc

SEQ ID NO: 4247389 - RNA, 74 nt, Salmonella enterica enterica serovar Typhi Ty2
cgcgcgccauuucauugagguuuuucucgcugggaucggucaucaccagacgggaaaucucaugauagcgcuug

SEQ ID NO: 4247390 - RNA, 70 nt, Salmonella enterica enterica serovar Typhi Ty2; identical to SEQ ID NO: 4245794

SEQ ID NO: 4247391 - RNA, 129 nt, Salmonella enterica enterica serovar Typhi Ty2; identical to SEQ ID NO: 4245793

SEQ ID NO: 4247392 - RNA, 91 nt, Salmonella enterica enterica serovar Typhi Ty2; identical to SEQ ID NO: 4246748

SEQ ID NO: 4247393 - RNA, 79 nt, Salmonella enterica enterica serovar Typhi Ty2; identical to SEQ ID NO: 4246386

SEQ ID NO: 4247394 - RNA, 65 nt, Salmonella enterica enterica serovar Typhi Ty2; identical to SEQ ID NO: 4246709

SEQ ID NO: 4247395 - RNA, 58 nt, Salmonella enterica enterica serovar Typhi Ty2; identical to SEQ ID NO: 4246327

SEQ ID NO: 4247396 - RNA, 60 nt, Salmonella enterica enterica serovar Typhi Ty2
ggcuugccuuuuuccggcauuugcggauauaguuuuuccgcugccgcaaaaucggcagcc

SEQ ID NO: 4247397 - RNA, 60 nt, Salmonella enterica enterica serovar Typhi Ty2
ccauuggguugucggcgaagaacgcgauacuuaucgucgaauucgccaaagacuuaaugg

SEQ ID NO: 4247398 - RNA, 67 nt, Salmonella enterica enterica serovar Typhi Ty2
guacacguugucguaugagcgaucgcugcgggggacuggaggcaucgaaguccgaucaacccuguau

SEQ ID NO: 4247399 - RNA, 66 nt, Salmonella enterica enterica serovar Typhi Ty2
aacgacggaagcaaagaugcgacugaaucaauaauuaacaaaauagcugcaucugauccgcucguu

SEQ ID NO: 4247400 - RNA, 129 nt, Salmonella enterica enterica serovar Typhi Ty2
cucagugccggaaucgaugcuggccgucgcuucaucaagaauuaauauuugcggggcgucaaccagcacgcgcgccagcgccaauagcuguuuuugcccgacggacagcguauuucccugcucgccgag

SEQ ID NO: 4247401 - RNA, 67 nt, Salmonella enterica enterica serovar Typhi Ty2; identical to SEQ ID NO: 4246429

SEQ ID NO: 4247402 - RNA, 66 nt, Salmonella enterica enterica serovar Typhi Ty2; identical to SEQ ID NO: 4246270

SEQ ID NO: 4247403 - RNA, 93 nt, Salmonella enterica enterica serovar Typhi Ty2; identical to SEQ ID NO: 4246035

SEQ ID NO: 4247404 - RNA, 64 nt, Salmonella enterica enterica serovar Typhi Ty2; identical to SEQ ID NO: 4246715

SEQ ID NO: 4247405 - RNA, 91 nt, Salmonella enterica enterica serovar Typhi Ty2; identical to SEQ ID NO: 4246563

SEQ ID NO: 4247406 - RNA, 85 nt, Salmonella enterica enterica serovar Typhi Ty2
uucggguucugucaauauuaacggcagcuugugccgggccauaccaucccgucaacccaaguagcguuaauaugacuuuacugaa

SEQ ID NO: 4247407 - RNA, 127 nt, Salmonella enterica enterica serovar Typhi Ty2; identical to SEQ ID NO: 4246364

SEQ ID NO: 4247408 - RNA, 77 nt, Salmonella enterica enterica serovar Typhi Ty2; identical to SEQ ID NO: 4246218

SEQ ID NO: 4247409 - RNA, 87 nt, Salmonella enterica enterica serovar Typhi Ty2
ggcaagcguaacagccuugaugcgcuguguucgcguuaugagauagauaauagcaaacguacuuugcacggcgcauugcucgaugcc

SEQ ID NO: 4247410 - RNA, 95 nt, Salmonella enterica enterica serovar Typhi Ty2
gcaaaacggagaggaccugaugaugcgccggauuuuaucgguauuacuggaaaacgaaucuggggcguuaucgcggguuaucggccucuuuucgc

SEQ ID NO: 4247411 - RNA, 60 nt, Salmonella enterica enterica serovar Typhi Ty2
auccugauacuuuccgagauagcccuucaugccccccggcgccucgaaggauuucaggau

SEQ ID NO: 4247412 - RNA, 57 nt, Salmonella enterica enterica serovar Typhi Ty2
cggucgauuguuucacgaaaucgccgguuaagcggaguaauuuguaaacagcgaucg

SEQ ID NO: 4247413 - RNA, 64 nt, Salmonella enterica enterica serovar Typhi Ty2
cggcgugauugcguugucccugcuguaugcggccuaugcgucgcagacgcuacgcggcgcgcug

SEQ ID NO: 4247414 - RNA, 70 nt, Salmonella enterica enterica serovar Typhi Ty2
gcagaauaucuggugauaagcggcagccugccacaagguauugaaagucgcuuuuacgcagaaauuaugc

SEQ ID NO: 4247415 - RNA, 66 nt, Salmonella enterica enterica serovar Typhi Ty2
gguuaauugggcugcggaugaugaauuaaugcagaaccgcauucagcgccaguacgcccagcaacc

SEQ ID NO: 4247416 - RNA, 62 nt, Salmonella enterica enterica serovar Typhi Ty2; identical to SEQ ID NO: 4245871

SEQ ID NO: 4247417 - RNA, 73 nt, Salmonella enterica enterica serovar Typhi Ty2; identical to SEQ ID NO: 4246345

SEQ ID NO: 4247418 - RNA, 64 nt, Salmonella enterica enterica serovar Typhi Ty2; identical to SEQ ID NO: 4246250

SEQ ID NO: 4247419 - RNA, 71 nt, Salmonella enterica enterica serovar Typhi Ty2; identical to SEQ ID NO: 4246658

SEQ ID NO: 4247420 - RNA, 87 nt, Salmonella enterica enterica serovar Typhi Ty2; identical to SEQ ID NO: 4246310

SEQ ID NO: 4247421 - RNA, 75 nt, Salmonella enterica enterica serovar Typhi Ty2
uugccugauggcgcgcuuaucuggccuaccugucguccucaggccggauaaggcgcuugcgccaucauccggcaa

SEQ ID NO: 4247422 - RNA, 85 nt, Salmonella enterica enterica serovar Typhi Ty2; identical to SEQ ID NO: 4246592

SEQ ID NO: 4247423 - RNA, 77 nt, Salmonella enterica enterica serovar Typhi Ty2
uccugguaucgucagcguguggaggugcuguggacgacgcuaaaucaguucagcaauaccggccugacgaugcagga

SEQ ID NO: 4247424 - RNA, 60 nt, Salmonella enterica enterica serovar Typhi Ty2; identical to SEQ ID NO: 4246496

SEQ ID NO: 4247425 - RNA, 84 nt, Salmonella enterica enterica serovar Typhi Ty2
uaaucaaucugccaacgcaggagaucgcugugcguaaagcccguauuacugcgcaccagaucaucgcugugauuagaucaguug

SEQ ID NO: 4247426 - RNA, 58 nt, Salmonella enterica enterica serovar Typhi Ty2; identical to SEQ ID NO: 4245956

SEQ ID NO: 4247427 - RNA, 96 nt, Salmonella enterica enterica serovar Typhi Ty2
uucaaacggucgucuggauaucuggugggauaaccgcuccgacuuuaacgcuaacggugaaaaggcgguuuucuucggcgcgauguaugaccugaa

SEQ ID NO: 4247428 - RNA, 55 nt, Salmonella enterica enterica serovar Typhi Ty2
gucuggcgaguuuacacggcacccgacaucuugggcauguugagcugguacaggc

SEQ ID NO: 4247429 - RNA, 77 nt, Salmonella enterica enterica serovar Typhi Ty2
gauuaucgucggggauacugcugucguuaaccaguucaauacggucaauggcgauaugcguguccacugucaccguc

SEQ ID NO: 4247430 - RNA, 81 nt, Salmonella enterica enterica serovar Typhi Ty2; identical to SEQ ID NO: 4246669

SEQ ID NO: 4247431 - RNA, 67 nt, Salmonella enterica enterica serovar Typhi Ty2; identical to SEQ ID NO: 4245872

SEQ ID NO: 4247432 - RNA, 55 nt, Salmonella enterica enterica serovar Typhi Ty2; identical to SEQ ID NO: 4245859

SEQ ID NO: 4247433 - RNA, 122 nt, Salmonella enterica enterica serovar Typhi Ty2; identical to SEQ ID NO: 4245921

SEQ ID NO: 4247434 - RNA, 60 nt, Salmonella enterica enterica serovar Typhi Ty2; identical to SEQ ID NO: 4246463

SEQ ID NO: 4247435 - RNA, 59 nt, Salmonella enterica enterica serovar Typhi Ty2
aaucugugcgugauaccaugcucuguacgugucuggugaaugagcaugauguacggauu

SEQ ID NO: 4247436 - RNA, 73 nt, Salmonella enterica enterica serovar Typhi Ty2; identical to SEQ ID NO: 4246015

SEQ ID NO: 4247437 - RNA, 68 nt, Salmonella enterica enterica serovar Typhi Ty2
ccgcggcggcaaucauguagugaaucgccggaaucgggcgauucaggaucgagacugccguacaaugg

SEQ ID NO: 4247438 - RNA, 92 nt, Salmonella enterica enterica serovar Typhi Ty2
gcguugacggaagggcuggaagucaugggcauuuaugacggcuaucugggccuguaugaagaucguaugguucagcuugaccguuacagcgu

SEQ ID NO: 4247439 - RNA, 55 nt, Salmonella enterica enterica serovar Typhi Ty2; identical to SEQ ID NO: 4246280

SEQ ID NO: 4247440 - RNA, 72 nt, Salmonella enterica enterica serovar Typhi Ty2
gcgggaaccccagaagcggaaaccgucuuuacgcacaagcguggugacgucguucugguucagcagucccgc

SEQ ID NO: 4247441 - RNA, 61 nt, Salmonella enterica enterica serovar Typhi Ty2
ucuuuuaccggcuggcuauuuucagcguaggccaggcgcaaaaugguuucgccgugggaga

SEQ ID NO: 4247442 - RNA, 114 nt, Salmonella enterica enterica serovar Typhi Ty2
uacgccgcccgccuugccgccaaaaaugguguccaucgagguugccagcgccaccgcauaaccgccgacgucgcgcuggacgccuuucgguuugccgguagugccggaggugua

SEQ ID NO: 4247443 - RNA, 75 nt, Salmonella enterica enterica serovar Typhi Ty2; identical to SEQ ID NO: 4246285

SEQ ID NO: 4247444 - RNA, 77 nt, Salmonella enterica enterica serovar Typhi Ty2
gauauugcgggcggaacugaaaaaauuugguugguuuuggccaucgaccggcuuaaucguucugcuguugggacguu

SEQ ID NO: 4247445 - RNA, 61 nt, Salmonella enterica enterica serovar Typhi Ty2; identical to SEQ ID NO: 4246418

SEQ ID NO: 4247446 - RNA, 56 nt, Salmonella enterica enterica serovar Typhi Ty2; identical to SEQ ID NO: 4245932

SEQ ID NO: 4247447 - RNA, 68 nt, Salmonella enterica enterica serovar Typhi Ty2; identical to SEQ ID NO: 4245986

SEQ ID NO: 4247448 - RNA, 58 nt, Salmonella enterica enterica serovar Typhi Ty2; identical to SEQ ID NO: 4246480

SEQ ID NO: 4247449 - RNA, 69 nt, Salmonella enterica enterica serovar Typhi Ty2
gcuaucggugagcugugaugcacagcggcgcgguagguucgcgccagcccgucaaagcuuacuggcggc

SEQ ID NO: 4247450 - RNA, 63 nt, Salmonella enterica enterica serovar Typhi Ty2; identical to SEQ ID NO: 4246075

SEQ ID NO: 4247451 - RNA, 87 nt, Salmonella enterica enterica serovar Typhi Ty2
ugccaaucaacgccagcagaauggguagguuuuucuccgccggagugguggagaaaugcuuguccaucgcgugcgcgccggaaagca

SEQ ID NO: 4247452 - RNA, 55 nt, Salmonella enterica enterica serovar Typhi Ty2; identical to SEQ ID NO: 4245976

SEQ ID NO: 4247453 - RNA, 57 nt, Salmonella enterica enterica serovar Typhi Ty2; identical to SEQ ID NO: 4246666

SEQ ID NO: 4247454 - RNA, 76 nt, Salmonella enterica enterica serovar Typhi Ty2; identical to SEQ ID NO: 4246272

SEQ ID NO: 4247455 - RNA, 91 nt, Salmonella enterica enterica serovar Typhi Ty2
gccccacggccaaaauaauauuuuccgcuuccagcgucaguucuccugaguggcguacaugguggaaggucacuuuauuuccgcugacggc

SEQ ID NO: 4247456 - RNA, 71 nt, Salmonella enterica enterica serovar Typhi Ty2; identical to SEQ ID NO: 4246380

SEQ ID NO: 4247457 - RNA, 68 nt, Salmonella enterica enterica serovar Typhi Ty2
ggauuuggcggcaauggcgauagauuucgucugguuggcgauuucugucaccuguugcuguucgaucu

SEQ ID NO: 4247458 - RNA, 72 nt, Salmonella enterica enterica serovar Typhi Ty2; identical to SEQ ID NO: 4246194

SEQ ID NO: 4247459 - RNA, 57 nt, Salmonella enterica enterica serovar Typhi Ty2; identical to SEQ ID NO: 4246648

SEQ ID NO: 4247460 - RNA, 55 nt, Salmonella enterica enterica serovar Typhi Ty2
gcucucuccagaagaugaagcccgugacgcggcgcaucauauuuaugagcagggc

SEQ ID NO: 4247461 - RNA, 71 nt, Salmonella enterica enterica serovar Typhi Ty2; identical to SEQ ID NO: 4246425

SEQ ID NO: 4247462 - RNA, 58 nt, Salmonella enterica enterica serovar Typhi Ty2
gcauugacgauuuuguacagguggcgcaggccaaccaccugccguugauugucgaugc

SEQ ID NO: 4247463 - RNA, 67 nt, Salmonella enterica enterica serovar Typhi Ty2
gcagcgguuaaagggaauguaguaaaccugucuuuagguuucucucacccgguugaccaucagcugc

SEQ ID NO: 4247464 - RNA, 63 nt, Salmonella enterica enterica serovar Typhi Ty2; identical to SEQ ID NO: 4246597

SEQ ID NO: 4247465 - RNA, 72 nt, Salmonella enterica enterica serovar Typhi Ty2; identical to SEQ ID NO: 4246190

SEQ ID NO: 4247466 - RNA, 74 nt, Salmonella enterica enterica serovar Typhi Ty2
ugcaguaucccggcagaaagguccagcgugccauccagcacugcaugcugugaauucagucggguuucacugua

SEQ ID NO: 4247467 - RNA, 55 nt, Salmonella enterica enterica serovar Typhi Ty2; identical to SEQ ID NO: 4246541

SEQ ID NO: 4247468 - RNA, 68 nt, Salmonella enterica enterica serovar Typhi Ty2; identical to SEQ ID NO: 4228091

SEQ ID NO: 4247469 - RNA, 76 nt, Salmonella enterica enterica serovar Typhi Ty2; identical to SEQ ID NO: 4246500

SEQ ID NO: 4247470 - RNA, 65 nt, Salmonella enterica enterica serovar Typhi Ty2; identical to SEQ ID NO: 4245865

SEQ ID NO: 4247471 - RNA, 56 nt, Salmonella enterica enterica serovar Typhi Ty2; identical to SEQ ID NO: 4245784

SEQ ID NO: 4247472 - RNA, 55 nt, Salmonella enterica enterica serovar Typhi Ty2; identical to SEQ ID NO: 4246474

SEQ ID NO: 4247473 - RNA, 63 nt, Salmonella enterica enterica serovar Typhi Ty2; identical to SEQ ID NO: 4246525

SEQ ID NO: 4247474 - RNA, 64 nt, Salmonella enterica enterica serovar Typhi Ty2
aauagagcggcuuugcuuccaggagacgccgauauccgccuccuggguacgcaagcugcugguu

SEQ ID NO: 4247475 - RNA, 57 nt, Salmonella enterica enterica serovar Typhi Ty2; identical to SEQ ID NO: 4245773

SEQ ID NO: 4247476 - RNA, 55 nt, Salmonella enterica enterica serovar Typhi Ty2
uguguccucauuuugcgggagcauaaucacugcucccgauuagaauuggauuaca

SEQ ID NO: 4247477 - RNA, 56 nt, Salmonella enterica enterica serovar Typhi Ty2; identical to SEQ ID NO: 4246066

SEQ ID NO: 4247478 - RNA, 87 nt, Salmonella enterica enterica serovar Typhi Ty2; identical to SEQ ID NO: 4246515

SEQ ID NO: 4247479 - RNA, 98 nt, Salmonella enterica enterica serovar Typhi Ty2
gucguguggcuggaauaugagagcauucaggccgauauuuucgaccauauuuuugccgugguggaagaguucggcuugcguauucaucagacgccgac

SEQ ID NO: 4247480 - RNA, 87 nt, Salmonella enterica enterica serovar Typhi Ty2; identical to SEQ ID NO: 4245982

SEQ ID NO: 4247481 - RNA, 62 nt, Salmonella enterica enterica serovar Typhi Ty2
cguagcuacguuacagaacguuagacuuugucuugaguauucacguccuuaacguagcuacg

SEQ ID NO: 4247482 - RNA, 64 nt, Salmonella enterica enterica serovar Typhi Ty2
ccggcgguuagcguugccacggcgaaaaaggauaauguugccgccgagcagccugcccagccgg

SEQ ID NO: 4247483 - RNA, 62 nt, Salmonella enterica enterica serovar Typhi Ty2
uggcugauuaucccguguccuguccacgacaaagcguggaaaagacgcggauaaucaugcua

SEQ ID NO: 4247484 - RNA, 112 nt, Salmonella enterica enterica serovar Typhi Ty2
guuaacgcuguagugccggauggcggcgaaaugccuuauccggccuacucuugagccggauguaggccugauaagcguagcgccaucaggcauaaaccuaucaggcguugac

SEQ ID NO: 4247485 - RNA, 82 nt, Salmonella enterica enterica serovar Typhi Ty2
guaauaagguugaguuucauuuuuuugcugcccgguugaauagaagugggagcagcaauagcagaucaaauuacgguguuac

SEQ ID NO: 4247486 - RNA, 81 nt, Salmonella enterica enterica serovar Typhi Ty2
gaggcguuuccagugcagcuccugguccguaaccuggcguaguacgcgcgccggugaucccaccagcaguugccuugccuc

SEQ ID NO: 4247487 - RNA, 80 nt, Salmonella enterica enterica serovar Typhi Ty2
ugucgcugcugggaauugaagcguugcuugaucgccugccggggagccuguccggcggagaaaaacagcgcguagcgaua

SEQ ID NO: 4247488 - RNA, 57 nt, Salmonella enterica enterica serovar Typhi Ty2; identical to SEQ ID NO: 4246301

SEQ ID NO: 4247489 - RNA, 83 nt, Salmonella enterica enterica serovar Typhi Ty2; identical to SEQ ID NO: 4246023

SEQ ID NO: 4247490 - RNA, 64 nt, Salmonella enterica enterica serovar Typhi Ty2
gggggaaaccgcuuaacgcaggggucggaugcagcagacaggccagcguaagcgcguuuucucc

SEQ ID NO: 4247491 - RNA, 66 nt, Salmonella enterica enterica serovar Typhi Ty2
ucagcgucaaaauuucauguauauucccagcacgcaugggcaugaauacacaggauuugacgauga

SEQ ID NO: 4247492 - RNA, 57 nt, Salmonella enterica enterica serovar Typhi Ty2; identical to SEQ ID NO: 4245783

SEQ ID NO: 4247493 - RNA, 61 nt, Salmonella enterica enterica serovar Typhi Ty2; identical to SEQ ID NO: 4246020

SEQ ID NO: 4247494 - RNA, 61 nt, Salmonella enterica enterica serovar Typhi Ty2
cauucugagacgcaugcugugggcaauagcgauagcucuucacugcaagccucucaggaug

SEQ ID NO: 4247495 - RNA, 69 nt, Salmonella enterica enterica serovar Typhi Ty2
gagggccacgggcguugucuccuugcugcgggucggcuggcuggcagccagauagcgcuugcuaacuuc

SEQ ID NO: 4247496 - RNA, 90 nt, Salmonella enterica enterica serovar Typhi Ty2
cguauuccggcacaacgccugugggugaauccggacugcggucugaaaacucgcgguuggccggaaacccgcgcggcguuagcgaacaug

SEQ ID NO: 4247497 - RNA, 59 nt, Salmonella enterica enterica serovar Typhi Ty2
cgcguuauucugcgcucguucuaucgagcguaucggugaccguugccagaauaucugcg

SEQ ID NO: 4247498 - RNA, 87 nt, Salmonella enterica enterica serovar Typhi Ty2; identical to SEQ ID NO: 4246599

SEQ ID NO: 4247499 - RNA, 60 nt, Salmonella enterica enterica serovar Typhi Ty2
acaugcacauuaaaagaaugguuauuggcacuacgauagcaguucuucagauggcaaugu

SEQ ID NO: 4247500 - RNA, 61 nt, Salmonella enterica enterica serovar Typhi Ty2; identical to SEQ ID NO: 4246559

SEQ ID NO: 4247501 - RNA, 129 nt, Salmonella enterica enterica serovar Typhi Ty2; identical to SEQ ID NO: 4246430

SEQ ID NO: 4247502 - RNA, 63 nt, Salmonella enterica enterica serovar Typhi Ty2; identical to SEQ ID NO: 4246506

SEQ ID NO: 4247503 - RNA, 60 nt, Salmonella enterica enterica serovar Typhi Ty2; identical to SEQ ID NO: 4246475

SEQ ID NO: 4247504 - RNA, 56 nt, Salmonella enterica enterica serovar Typhi Ty2
gucggguugaaaagcaaacgucgcauugcguagcggcaccagcacuucaaacugac

SEQ ID NO: 4247505 - RNA, 81 nt, Salmonella enterica enterica serovar Typhi Ty2; identical to SEQ ID NO: 4246582

SEQ ID NO: 4247506 - RNA, 69 nt, Salmonella enterica enterica serovar Typhi Ty2; identical to SEQ ID NO: 4246002

SEQ ID NO: 4247507 - RNA, 65 nt, Salmonella enterica enterica serovar Typhi Ty2; identical to SEQ ID NO: 4246300

SEQ ID NO: 4247508 - RNA, 56 nt, Salmonella enterica enterica serovar Typhi Ty2
ucugcguuggauaucaugcagauaaucaucgguggugauuucaauauccagccaga

SEQ ID NO: 4247509 - RNA, 66 nt, Salmonella enterica enterica serovar Typhi Ty2
ucucguuauuaacgccguuccagaauaaagguaaagcgcaacuggaggugaaaauugguagcguga

SEQ ID NO: 4247510 - RNA, 63 nt, Salmonella enterica enterica serovar Typhi Ty2
gggcgaugcuggaugaauuacgcagccgcgauugggugccgcguagcguccggcguaaugccc

SEQ ID NO: 4247511 - RNA, 72 nt, Salmonella enterica enterica serovar Typhi Ty2
guuguuggcuggauggcugacaaauguucccugccgccacuccuuacucuugucaccuuuucagcuaucagc

SEQ ID NO: 4247512 - RNA, 74 nt, Salmonella enterica enterica serovar Typhi Ty2; identical to SEQ ID NO: 4246737

SEQ ID NO: 4247513 - RNA, 57 nt, Salmonella enterica enterica serovar Typhi Ty2
gcuuugcgauccagcuugccauuagcgcuaagcggcaagcuggcaaguugcaacagc

SEQ ID NO: 4247514 - RNA, 72 nt, Salmonella enterica enterica serovar Typhi Ty2; identical to SEQ ID NO: 4246663

SEQ ID NO: 4247515 - RNA, 59 nt, Salmonella enterica enterica serovar Typhi Ty2
gucgcaaugucggucaaaaucaggcgguaaacguuucugauaaugcugacauuaugcgc

SEQ ID NO: 4247516 - RNA, 61 nt, Salmonella enterica enterica serovar Typhi Ty2
gcggcuauugauuuuccggaugaggagaucgacuuucucucugacggcaaaaucgaagcgc

SEQ ID NO: 4247517 - RNA, 73 nt, Salmonella enterica enterica serovar Typhi Ty2; identical to SEQ ID NO: 4246434

SEQ ID NO: 4247518 - RNA, 68 nt, Salmonella enterica enterica serovar Typhi Ty2
ggguucgccagggcguugauggcuuuggcguguuugaugacgccgccgauguaguacagcgccugcuc

SEQ ID NO: 4247519 - RNA, 117 nt, Salmonella enterica enterica serovar Typhi Ty2
uaagcgugaacgcuggauugaaguggauauggcguggcacgagcauaucuacgaaaugagcgccaaucccuuucuaaucucuuuugcuacgcuauuucauucgguuuaucacacuua

SEQ ID NO: 4247520 - RNA, 67 nt, Salmonella enterica enterica serovar Typhi Ty2; identical to SEQ ID NO: 4246664

SEQ ID NO: 4247521 - RNA, 94 nt, Salmonella enterica enterica serovar Typhi Ty2; identical to SEQ ID NO: 4246268

SEQ ID NO: 4247522 - RNA, 79 nt, Salmonella enterica enterica serovar Typhi Ty2; identical to SEQ ID NO: 4246728

SEQ ID NO: 4247523 - RNA, 76 nt, Salmonella enterica enterica serovar Typhi Ty2; identical to SEQ ID NO: 4246243

SEQ ID NO: 4247524 - RNA, 59 nt, Salmonella enterica enterica serovar Typhi Ty2; identical to SEQ ID NO: 4246011

SEQ ID NO: 4247525 - RNA, 67 nt, Salmonella enterica enterica serovar Typhi Ty2
ccgauaacgcgcagauuaaucuggugacgcaggauguuaccucgaacgaucuggugacguuauacgg

SEQ ID NO: 4247526 - RNA, 79 nt, Salmonella enterica enterica serovar Typhi Ty2; identical to SEQ ID NO: 4246483

SEQ ID NO: 4247527 - RNA, 64 nt, Salmonella enterica enterica serovar Typhi Ty2; identical to SEQ ID NO: 4246098

SEQ ID NO: 4247528 - RNA, 69 nt, Salmonella enterica enterica serovar Typhi Ty2; identical to SEQ ID NO: 4245889

SEQ ID NO: 4247529 - RNA, 74 nt, Salmonella enterica enterica serovar Typhi Ty2
gaauccggcaugguaaauaagcggauuuucuccggaccgugagauucaucuaauuugauuacuuugccaggauc

SEQ ID NO: 4247530 - RNA, 60 nt, Salmonella enterica enterica serovar Typhi Ty2
uugugaugacagcagccggaaagauuaucaauaaucgggcagucggcgcugucaucgccg

SEQ ID NO: 4247531 - RNA, 83 nt, Salmonella enterica enterica serovar Typhi Ty2
ugccggauggcgcugccgcuuauccggccuacagacuguaccguuuuguaggccggauaagguguuuacgccgccauccggca

SEQ ID NO: 4247532 - RNA, 77 nt, Salmonella enterica enterica serovar Typhi Ty2; identical to SEQ ID NO: 4246251

SEQ ID NO: 4247533 - RNA, 67 nt, Salmonella enterica enterica serovar Typhi Ty2
uuauucauccaugcggcagucgcuucugcgcucuccagcggaggcgaauauuccgcaggaaggauga

SEQ ID NO: 4247534 - RNA, 62 nt, Salmonella enterica enterica serovar Typhi Ty2
cuuuucuuaugauguagaacgugcaacgcaauugaugcuugcaguucacuaucaaggcaaag

SEQ ID NO: 4247535 - RNA, 63 nt, Salmonella enterica enterica serovar Typhi Ty2
auugaugacaucgaccugaaccuggaagacuuuguccagcgcgucaaugccgauaucgucaau

SEQ ID NO: 4247536 - RNA, 65 nt, Salmonella enterica enterica serovar Typhi Ty2; identical to SEQ ID NO: 4245991

SEQ ID NO: 4247537 - RNA, 65 nt, Salmonella enterica enterica serovar Typhi Ty2; identical to SEQ ID NO: 4245911

SEQ ID NO: 4247538 - RNA, 55 nt, Salmonella enterica enterica serovar Typhi Ty2; identical to SEQ ID NO: 4246224

SEQ ID NO: 4247539 - RNA, 61 nt, Salmonella enterica enterica serovar Typhi Ty2
aaagccgcguugaagccuaucccuccgaaccgccguuugauggcguuaucagccgcgcuuu

SEQ ID NO: 4247540 - RNA, 56 nt, Salmonella enterica enterica serovar Typhi Ty2
gaauaucuguugccaugcccaccgcaauaccgguggugccguucagcaggauguuc

SEQ ID NO: 4247541 - RNA, 79 nt, Salmonella enterica enterica serovar Typhi Ty2; identical to SEQ ID NO: 4246502

SEQ ID NO: 4247542 - RNA, 67 nt, Salmonella enterica enterica serovar Typhi Ty2; identical to SEQ ID NO: 4246471

SEQ ID NO: 4247543 - RNA, 93 nt, Salmonella enterica enterica serovar Typhi Ty2
caguugcaggguguagaugagcguaucggcgauucccuguucauccucgacuaaccagaccugcgguugcugcauacgcuuucccuguuauug

SEQ ID NO: 4247544 - RNA, 65 nt, Salmonella enterica enterica serovar Typhi Ty2
gcagguuaaugucgacgaugacgaaaugacaugucgucaccgcgucgaaacggcaguaacugugc

SEQ ID NO: 4247545 - RNA, 70 nt, Salmonella enterica enterica serovar Typhi Ty2; identical to SEQ ID NO: 4246262

SEQ ID NO: 4247546 - RNA, 63 nt, Salmonella enterica enterica serovar Typhi Ty2
ggccugauaagcgccgucuacaaaaaagccccucgugaagaggggcuuaauggcuaucgggcu

SEQ ID NO: 4247547 - RNA, 60 nt, Salmonella enterica enterica serovar Typhi Ty2
cgcaucuucgaagaagaagaaggaguggauaugcaguccgucuucgucuucaaagaagcg

SEQ ID NO: 4247548 - RNA, 70 nt, Salmonella enterica enterica serovar Typhi Ty2; identical to SEQ ID NO: 4246408

SEQ ID NO: 4247549 - RNA, 82 nt, Salmonella enterica enterica serovar Typhi Ty2
aagguguugaccuugugacugagcagcggcuguucgauggcaucccaguucaguucgcuguucaggaaggcuucaacgcguu

SEQ ID NO: 4247550 - RNA, 85 nt, Salmonella enterica enterica serovar Typhi Ty2; identical to SEQ ID NO: 4246245

SEQ ID NO: 4247551 - RNA, 59 nt, Salmonella enterica enterica serovar Typhi Ty2; identical to SEQ ID NO: 4246316

SEQ ID NO: 4247552 - RNA, 78 nt, Salmonella enterica enterica serovar Typhi Ty2
cccauucaggcgucaacagguucgguuguacaguccguaaccggacaguguaaguaaaccugcuacgcuuguaugagg

SEQ ID NO: 4247553 - RNA, 70 nt, Salmonella enterica enterica serovar Typhi Ty2; identical to SEQ ID NO: 4245887

SEQ ID NO: 4247554 - RNA, 58 nt, Salmonella enterica enterica serovar Typhi Ty2; identical to SEQ ID NO: 4245763

SEQ ID NO: 4247555 - RNA, 97 nt, Salmonella enterica enterica serovar Typhi Ty2; identical to SEQ ID NO: 4246302

SEQ ID NO: 4247556 - RNA, 75 nt, Salmonella enterica enterica serovar Typhi Ty2; identical to SEQ ID NO: 4246413

SEQ ID NO: 4247557 - RNA, 78 nt, Salmonella enterica enterica serovar Typhi Ty2; identical to SEQ ID NO: 4245819

SEQ ID NO: 4247558 - RNA, 64 nt, Salmonella enterica enterica serovar Typhi Ty2
uacuuuuuucuuacuuuuggccuuucagaaguuuccugaguuugcguuaagguaaagaaaagug

SEQ ID NO: 4247559 - RNA, 74 nt, Salmonella enterica enterica serovar Typhi Ty2
acgccaaagaccuugcgggucgugacgugguggcgcguuccaucaugaucgaaauccgugaaggucgcggcugu

SEQ ID NO: 4247560 - RNA, 58 nt, Salmonella enterica enterica serovar Typhi Ty2
cuggccgugguggucgacgaucauuuucagggggugacggagaucguccgcggcgcag

SEQ ID NO: 4247561 - RNA, 99 nt, Salmonella enterica enterica serovar Typhi Ty2; identical to SEQ ID NO: 4246620

SEQ ID NO: 4247562 - RNA, 63 nt, Salmonella enterica enterica serovar Typhi Ty2; identical to SEQ ID NO: 4246426

SEQ ID NO: 4247563 - RNA, 65 nt, Salmonella enterica enterica serovar Typhi Ty2; identical to SEQ ID NO: 4246072

SEQ ID NO: 4247564 - RNA, 85 nt, Salmonella enterica enterica serovar Typhi Ty2; identical to SEQ ID NO: 4245965

SEQ ID NO: 4247565 - RNA, 80 nt, Salmonella enterica enterica serovar Typhi Ty2
gccgugaugacggcguugaaguucgucauaucgugggcgcuaucgcuaacgaaggcgacauuagcagccguuacauuggu

SEQ ID NO: 4247566 - RNA, 69 nt, Salmonella enterica enterica serovar Typhi Ty2
ccaccucguuguaugccgccauugaucucgguuccaauaguuuucauaugcuggucgugcgcgaggcgg

SEQ ID NO: 4247567 - RNA, 60 nt, Salmonella enterica enterica serovar Typhi Ty2; identical to SEQ ID NO: 4245769

SEQ ID NO: 4247568 - RNA, 86 nt, Salmonella enterica enterica serovar Typhi Ty2; identical to SEQ ID NO: 4246699

SEQ ID NO: 4247569 - RNA, 65 nt, Salmonella enterica enterica serovar Typhi Ty2
guccgcgguaucgcggugaaguccggggacgccgucuccgugggcgacacccugaugacgcuggc

SEQ ID NO: 4247570 - RNA, 63 nt, Salmonella enterica enterica serovar Typhi Ty2; identical to SEQ ID NO: 4246332

SEQ ID NO: 4247571 - RNA, 91 nt, Salmonella enterica enterica serovar Typhi Ty2
gcuuuucaccauguacagaauauccaucagcggcuggcgcagcguuucgcccaggcugcugaagguguucugcgcuccgguuuugaccagc

SEQ ID NO: 4247572 - RNA, 61 nt, Salmonella enterica enterica serovar Typhi Ty2; identical to SEQ ID NO: 4246256

SEQ ID NO: 4247573 - RNA, 60 nt, Salmonella enterica enterica serovar Typhi Ty2
uugaucaggcaggcguccgguuggaagcuagcauacccugccgcgauugccgccugacga

SEQ ID NO: 4247574 - RNA, 66 nt, Salmonella enterica enterica serovar Typhi Ty2; identical to SEQ ID NO: 4246160

SEQ ID NO: 4247575 - RNA, 83 nt, Salmonella enterica enterica serovar Typhi Ty2
aaugucugauggcgcugcgcuuaucaggccuaccagccgagugcuuauguaggccugauaagguaaagccgccauccggcauu

SEQ ID NO: 4247576 - RNA, 71 nt, Salmonella enterica enterica serovar Typhi Ty2
gaagaugaugagguaaaagacgcccgauaaacguugcgcuaucgggcgugcgcuauuacaucgugguuuuu

SEQ ID NO: 4247577 - RNA, 55 nt, Salmonella enterica enterica serovar Typhi Ty2; identical to SEQ ID NO: 4227996

SEQ ID NO: 4247578 - RNA, 64 nt, Salmonella enterica enterica serovar Typhi Ty2
cgcugacggucucgcuguuucaguacgguaaauucaccgccuuugaugcggcgaugacgcagcg

SEQ ID NO: 4247579 - RNA, 65 nt, Salmonella enterica enterica serovar Typhi Ty2
gcgcucaggacucguuugggaacgauaacgcuuauguuggagcucaccgaacguagccugauugu

SEQ ID NO: 4247580 - RNA, 60 nt, Salmonella enterica enterica serovar Typhi Ty2; identical to SEQ ID NO: 4246687

SEQ ID NO: 4247581 - RNA, 65 nt, Salmonella enterica enterica serovar Typhi Ty2
ggaaacucgugaagauuagcagagcggggaaacucuuuuccccgacggccucuucacgcagcgcc

SEQ ID NO: 4247582 - RNA, 74 nt, Salmonella enterica enterica serovar Typhi Ty2
gggcaaauaccuauaacgaaccgggucgggcuuauuaugccggugugacggccucguuuugauggguuaugccc

SEQ ID NO: 4247583 - RNA, 92 nt, Salmonella enterica enterica serovar Typhi Ty2; identical to SEQ ID NO: 4246639

SEQ ID NO: 4247584 - RNA, 94 nt, Salmonella enterica enterica serovar Typhi Ty2
uccgggcgacaucaucagguuugcggcagcccgccaggauuugaaagcccuggcguuuaaguucaagcgcgcuguccagaccgauuccgcugga

SEQ ID NO: 4247585 - RNA, 97 nt, Salmonella enterica enterica serovar Typhi Ty2; identical to SEQ ID NO: 4246694

SEQ ID NO: 4247586 - RNA, 58 nt, Salmonella enterica enterica serovar Typhi Ty2
ccucggucagcauggcgcgccaggccaaaucggcccaggcgucauacagcgacugagg

SEQ ID NO: 4247587 - RNA, 58 nt, Salmonella enterica enterica serovar Typhi Ty2
aggaucuuccacugaugauucguccucugcuuaguaacggauuacuggugggaauccu

SEQ ID NO: 4247588 - RNA, 107 nt, Salmonella enterica enterica serovar Typhi Ty2; identical to SEQ ID NO: 4246696

SEQ ID NO: 4247589 - RNA, 57 nt, Salmonella enterica enterica serovar Typhi Ty2; identical to SEQ ID NO: 4245806

SEQ ID NO: 4247590 - RNA, 69 nt, Salmonella enterica enterica serovar Typhi Ty2; identical to SEQ ID NO: 4246247

SEQ ID NO: 4247591 - RNA, 59 nt, Salmonella enterica enterica serovar Typhi Ty2
guuuucaggacucugucagcuuaaugauuauuucucgaaagcugagugaguccgaaaau

SEQ ID NO: 4247592 - RNA, 55 nt, Salmonella enterica enterica serovar Typhi Ty2; identical to SEQ ID NO: 4246273

SEQ ID NO: 4247593 - RNA, 80 nt, Salmonella enterica enterica serovar Typhi Ty2
gcgucgaccgucgcggcggcgcuuucguuguucgcuauaucgguggcgguagcgauaagcgccuggccguuagucugcgc

SEQ ID NO: 4247594 - RNA, 78 nt, Salmonella enterica enterica serovar Typhi Ty2
uuagguauuaaggucauguggguggacgcgguaaccaucgaacagaucgccgacgcgcuccgccaacuggccgccugg

SEQ ID NO: 4247595 - RNA, 79 nt, Salmonella enterica enterica serovar Typhi Ty2; identical to SEQ ID NO: 4246469

SEQ ID NO: 4247596 - RNA, 75 nt, Salmonella enterica enterica serovar Typhi Ty2; identical to SEQ ID NO: 4246219

SEQ ID NO: 4247597 - RNA, 67 nt, Salmonella enterica enterica serovar Typhi Ty2
cgugcgauacgcgcuugccauccagcucguaauaguuacgguagcugccggaggugcugaugccaug

SEQ ID NO: 4247598 - RNA, 86 nt, Salmonella enterica enterica serovar Typhi Ty2
uaucaaaaauaaugugagagauauuggauuuuacuuauugauuuauaagaaaaaacuucgaaauuucuugcgucguauuaagggua

SEQ ID NO: 4247599 - RNA, 56 nt, Salmonella enterica enterica serovar Typhi Ty2; identical to SEQ ID NO: 4246258

SEQ ID NO: 4247600 - RNA, 56 nt, Salmonella enterica enterica serovar Typhi Ty2
ccaugcggauguugauaucuucgaucgcgaagcgcguuuuaucgacaccguaaugg

SEQ ID NO: 4247601 - RNA, 95 nt, Salmonella enterica enterica serovar Typhi Ty2
cgcccuggcgaucauguucuggggauuugugggaauugaggcuuuuacgcauuugucgucugaauuuaaaaauccugaacgugauuuuccgcgcg

SEQ ID NO: 4247602 - RNA, 96 nt, Salmonella enterica enterica serovar Typhi Ty2; identical to SEQ ID NO: 4246093

SEQ ID NO: 4247603 - RNA, 58 nt, Salmonella enterica enterica serovar Typhi Ty2; identical to SEQ ID NO: 4246232

SEQ ID NO: 4247604 - RNA, 80 nt, Salmonella enterica enterica serovar Typhi Ty2
ggugugaaucggcaugagagugugagugcgccauaacgucauuccuuuguuauucucaucaauacuguagauaucauacu

SEQ ID NO: 4247605 - RNA, 55 nt, Salmonella enterica enterica serovar Typhi Ty2; identical to SEQ ID NO: 4246182

SEQ ID NO: 4247606 - RNA, 82 nt, Salmonella enterica enterica serovar Typhi Ty2
gcuaaauccagugauuauugguauacguuuagguauacgguaggauguauaccuaaaugcguauaccaauucaugaaggagc

SEQ ID NO: 4247607 - RNA, 67 nt, Salmonella enterica enterica serovar Typhi Ty2; identical to SEQ ID NO: 4246254

SEQ ID NO: 4247608 - RNA, 61 nt, Salmonella enterica enterica serovar Typhi Ty2; identical to SEQ ID NO: 4246468

SEQ ID NO: 4247609 - RNA, 60 nt, Salmonella enterica enterica serovar Typhi Ty2
accugcugugcagccacgguagcacguuguucaucugcugcuccaguuuccacggcgggu

SEQ ID NO: 4247610 - RNA, 73 nt, Salmonella enterica enterica serovar Typhi Ty2
uaaacuucgugaggaaugguaauggucaaagggucugcgcuuuuugauaccaauauccucaucgaccuguuua

SEQ ID NO: 4247611 - RNA, 60 nt, Salmonella enterica enterica serovar Typhi Ty2; identical to SEQ ID NO: 4246249

SEQ ID NO: 4247612 - RNA, 98 nt, Salmonella enterica enterica serovar Typhi Ty2; identical to SEQ ID NO: 4246514

SEQ ID NO: 4247613 - RNA, 80 nt, Salmonella enterica enterica serovar Typhi Ty2
cauacuugcggguugccagcacuacggcagggucgauuuucagggugauauuguccgugcugcugguaaucagcaccaug

SEQ ID NO: 4247614 - RNA, 66 nt, Salmonella enterica enterica serovar Typhi Ty2; identical to SEQ ID NO: 4245824

SEQ ID NO: 4247615 - RNA, 67 nt, Salmonella enterica enterica serovar Typhi Ty2; identical to SEQ ID NO: 4246158

SEQ ID NO: 4247616 - RNA, 77 nt, Salmonella enterica enterica serovar Typhi Ty2
ucgccacgaccgaggaauaacgcgugaugcuugucagagaaaucuucugcaagcagcucgaugcguuuguccugcga

SEQ ID NO: 4247617 - RNA, 100 nt, Salmonella enterica enterica serovar Typhi Ty2
gcgaucacgguaugaugcugcugauauuuuccgccuuuaugcugcguuauuucggcaaaacggcggggauuaucgcccuuauuauauuugugguuuucgc

SEQ ID NO: 4247618 - RNA, 77 nt, Salmonella enterica enterica serovar Typhi Ty2
gccucuacacuggagaacaugggcgugaguuuuaucaaugccaucaugacgcuuaucgccuuucugccgguguuggu

SEQ ID NO: 4247619 - RNA, 64 nt, Salmonella enterica enterica serovar Typhi Ty2
uuucgucuggcauuaucgaucaguaccagccgucuuaucuugauugaagccgaugccggugaaa

SEQ ID NO: 4247620 - RNA, 86 nt, Salmonella enterica enterica serovar Typhi Ty2; identical to SEQ ID NO: 4246032

SEQ ID NO: 4247621 - RNA, 89 nt, Salmonella enterica enterica serovar Typhi Ty2
gcgcucacgcuaaccugcacagugugggugggcagauggggccucacgcugaccaguccgcgaugcucgcccaccaccaggcugcgcgc

SEQ ID NO: 4247622 - RNA, 74 nt, Salmonella enterica enterica serovar Typhi Ty2; identical to SEQ ID NO: 4246088

SEQ ID NO: 4247623 - RNA, 86 nt, Salmonella enterica enterica serovar Typhi Ty2
ugucucgccugacacguuagcgggugauguauggcugcgcuguuggaauugcgccauggcugccuggcgcugacugucgcgagaca

SEQ ID NO: 4247624 - RNA, 71 nt, Salmonella enterica enterica serovar Typhi Ty2
cgcucauuuuugaaucaaugauguggugaauuuuaucaacuauaugcauuaaugguuuaaccacaauggcg

SEQ ID NO: 4247625 - RNA, 69 nt, Salmonella enterica enterica serovar Typhi Ty2; identical to SEQ ID NO: 4246718

SEQ ID NO: 4247626 - RNA, 59 nt, Salmonella enterica enterica serovar Typhi Ty2; identical to SEQ ID NO: 4246580

SEQ ID NO: 4247627 - RNA, 74 nt, Salmonella enterica enterica serovar Typhi Ty2
gcuguacgucuauccuuaguccguagugauacugacgcuauuuuauaacggcuaugggaaggaugugaaacggu

SEQ ID NO: 4247628 - RNA, 56 nt, Salmonella enterica enterica serovar Typhi Ty2
ucuuucgacuuuucgcccgaagagcucagcacuucuucgagcguaucggucaggga

SEQ ID NO: 4247629 - RNA, 55 nt, Salmonella enterica enterica serovar Typhi Ty2; identical to SEQ ID NO: 4245834

SEQ ID NO: 4247630 - RNA, 91 nt, Salmonella enterica enterica serovar Typhi Ty2
ggccagaugacguccggcgcugugcugguaucuguugccguuaccgcgucaauauaauccagcacagcguuaagucggguguuuucuggcu

SEQ ID NO: 4247631 - RNA, 64 nt, Salmonella enterica enterica serovar Typhi Ty2; identical to SEQ ID NO: 4245772

SEQ ID NO: 4247632 - RNA, 55 nt, Salmonella enterica enterica serovar Typhi Ty2
gcacaacgcguauugaaaaugcaggaaaaucccggcauguuuuucaccguugugc

SEQ ID NO: 4247633 - RNA, 66 nt, Salmonella enterica enterica serovar Typhi Ty2; identical to SEQ ID NO: 4246163

SEQ ID NO: 4247634 - RNA, 88 nt, Salmonella enterica enterica serovar Typhi Ty2
gcucucuaauuuacccucuucaauagccuugcguaaacccgccaucaaacgcugguaguaacgcaaguuaugaaugguauugagacgc

SEQ ID NO: 4247635 - RNA, 67 nt, Salmonella enterica enterica serovar Typhi Ty2; identical to SEQ ID NO: 4246711

SEQ ID NO: 4247636 - RNA, 100 nt, Salmonella enterica enterica serovar Typhi Ty2; identical to SEQ ID NO: 4246518

SEQ ID NO: 4247637 - RNA, 63 nt, Salmonella enterica enterica serovar Typhi Ty2
gccaguauauaucguuucaugcuucacuccuuuacgguauugaugcaggaaaauauaucuggc

SEQ ID NO: 4247638 - RNA, 78 nt, Salmonella enterica enterica serovar Typhi Ty2
uugccggauggcgcugcgcuuuccggccuacaaauccaggccuguaggccggauaaggcguuagccgccauccggcga

SEQ ID NO: 4247639 - RNA, 101 nt, Salmonella enterica enterica serovar Typhi Ty2; identical to SEQ ID NO: 4246508

SEQ ID NO: 4247640 - RNA, 67 nt, Salmonella enterica enterica serovar Typhi Ty2
gaugcugaccuggucuuuauucagccugacagcagcuauguucugaaaaaugaagaucuggaauauc

SEQ ID NO: 4247641 - RNA, 88 nt, Salmonella enterica enterica serovar Typhi Ty2
uaugcugucgagaauauggcguaccaacauuucguugggaucccgcacugacgucagguuguaugcuuuguuccauuugugcagcaua

SEQ ID NO: 4247642 - RNA, 73 nt, Salmonella enterica enterica serovar Typhi Ty2
cguugcggugugcgcccugcgccaguuguuccagaaugguuuucaggaacgggcuuuucaggguguaguagcg

SEQ ID NO: 4247643 - RNA, 65 nt, Salmonella enterica enterica serovar Typhi Ty2; identical to SEQ ID NO: 4246586

SEQ ID NO: 4247644 - RNA, 81 nt, Salmonella enterica enterica serovar Typhi Ty2; identical to SEQ ID NO: 4245901

SEQ ID NO: 4247645 - RNA, 55 nt, Salmonella enterica enterica serovar Typhi Ty2; identical to SEQ ID NO: 4246679

SEQ ID NO: 4247646 - RNA, 57 nt, Salmonella enterica enterica serovar Typhi Ty2
guucgaaaucccagguugcccagcagcaccugacacggcucaacccggauaucgaac

SEQ ID NO: 4247647 - RNA, 78 nt, Salmonella enterica enterica serovar Typhi Ty2
gcugccgcccguuugccgcgaacgcgcuuuaucgacgcgguagaagcguucggucagacgaggaauaugcucggcagc

SEQ ID NO: 4247648 - RNA, 58 nt, Salmonella enterica enterica serovar Typhi Ty2
gccuguuuuugcgcaaagagggagaauggcgauuuccgccucuugauaaaacgcaggc

SEQ ID NO: 4247649 - RNA, 83 nt, Salmonella enterica enterica serovar Typhi Ty2; identical to SEQ ID NO: 4246740

SEQ ID NO: 4247650 - RNA, 60 nt, Salmonella enterica enterica serovar Typhi Ty2
cuggcaggcgggauggacauuauccgcgccaugcgccuguuggugccgcccgccuggcag

SEQ ID NO: 4247651 - RNA, 65 nt, Salmonella enterica enterica serovar Typhi Ty2; identical to SEQ ID NO: 4246012

SEQ ID NO: 4247652 - RNA, 99 nt, Salmonella enterica enterica serovar Typhi Ty2
ucagcgcgcuggucacguuuagcggccugcuggucucauuguuuuucgccgcccugguggauuacguggugcgcggcagccguuuuuaucagacgcuga

SEQ ID NO: 4247653 - RNA, 89 nt, Salmonella enterica enterica serovar Typhi Ty2; identical to SEQ ID NO: 4245882

SEQ ID NO: 4247654 - RNA, 78 nt, Salmonella enterica enterica serovar Typhi Ty2; identical to SEQ ID NO: 4245867

SEQ ID NO: 4247655 - RNA, 74 nt, Salmonella enterica enterica serovar Typhi Ty2
gccgccucgaugcauccagaaugauuuugugucuauuaaaggguuagaauuuuuucaggauaucgucgagcggc

SEQ ID NO: 4247656 - RNA, 84 nt, Salmonella enterica enterica serovar Typhi Ty2; identical to SEQ ID NO: 4246712

SEQ ID NO: 4247657 - RNA, 68 nt, Salmonella enterica enterica serovar Typhi Ty2
ggcagagagauuacgcagcagcuuuucuugcuggggugcggagcggaaaugcugcgucaugccucgcc

SEQ ID NO: 4247658 - RNA, 70 nt, Salmonella enterica enterica serovar Typhi Ty2; identical to SEQ ID NO: 4245814

SEQ ID NO: 4247659 - RNA, 80 nt, Salmonella enterica enterica serovar Typhi Ty2
cuggaggaggacgcaugauuaaagugcugauuguggaugaugagccguuagcgcgggaaaaucugcggauuuugcuccag

SEQ ID NO: 4247660 - RNA, 59 nt, Salmonella enterica enterica serovar Typhi Ty2; identical to SEQ ID NO: 4246149

SEQ ID NO: 4247661 - RNA, 69 nt, Salmonella enterica enterica serovar Typhi Ty2
uccuaaagugaauggcaaugcgggcagcuuuuuuaaaaaucccguugucgcagccgauaucgcuaugga

SEQ ID NO: 4247662 - RNA, 81 nt, Salmonella enterica enterica serovar Typhi Ty2
gauuccgcugcgguuuaugucaacgccucuacccguuuuaccgauggcgggcaguuugggcuuggcgcagaaguggcgguc

SEQ ID NO: 4247663 - RNA, 56 nt, Salmonella enterica enterica serovar Typhi Ty2
ccgguuuuccaggccgcgcgugaaaacagcgaugacgcgcaggaauggcagaccgg

SEQ ID NO: 4247664 - RNA, 84 nt, Salmonella enterica enterica serovar Typhi Ty2; identical to SEQ ID NO: 4246517

SEQ ID NO: 4247665 - RNA, 128 nt, Salmonella enterica enterica serovar Typhi Ty2; identical to SEQ ID NO: 4246352

SEQ ID NO: 4247666 - RNA, 78 nt, Salmonella enterica enterica serovar Typhi Ty2; identical to SEQ ID NO: 4246180

SEQ ID NO: 4247667 - RNA, 58 nt, Salmonella enterica enterica serovar Typhi Ty2
guuugaucuuaggcuuucguaacgugaucggcgaugugccgaugagccacggucaaac

SEQ ID NO: 4247668 - RNA, 60 nt, Salmonella enterica enterica serovar Typhi Ty2; identical to SEQ ID NO: 4246402

SEQ ID NO: 4247669 - RNA, 59 nt, Salmonella enterica enterica serovar Typhi Ty2; identical to SEQ ID NO: 4245985

SEQ ID NO: 4247670 - RNA, 94 nt, Salmonella enterica enterica serovar Typhi Ty2
cgaccugccauggcacagcaaauagccgguaauagcgccacuagcgcggcggcgcagguagggcuguuacuggaugccggcgccgggcuggucg

SEQ ID NO: 4247671 - RNA, 62 nt, Salmonella enterica enterica serovar Typhi Ty2; identical to SEQ ID NO: 4246623

SEQ ID NO: 4247672 - RNA, 66 nt, Salmonella enterica enterica serovar Typhi Ty2; identical to SEQ ID NO: 4246627

SEQ ID NO: 4247673 - RNA, 78 nt, Salmonella enterica enterica serovar Typhi Ty2
gggcguacuggccgugguguuuauugcugugcuuuuuugcgcguuacgaagcgccuggcaacucacggcauuacgucu

SEQ ID NO: 4247674 - RNA, 60 nt, Salmonella enterica enterica serovar Typhi Ty2; identical to SEQ ID NO: 4245908

SEQ ID NO: 4247675 - RNA, 64 nt, Salmonella enterica enterica serovar Typhi Ty2; identical to SEQ ID NO: 4246610

SEQ ID NO: 4247676 - RNA, 129 nt, Salmonella enterica enterica serovar Typhi Ty2; identical to SEQ ID NO: 4246353

SEQ ID NO: 4247677 - RNA, 67 nt, Salmonella enterica enterica serovar Typhi Ty2
cguaauuuuuauuaccggcgcuauuggguuaccggcaggcguuccgcgaccgguaguaaaaauaacg

SEQ ID NO: 4247678 - RNA, 66 nt, Salmonella enterica enterica serovar Typhi Ty2; identical to SEQ ID NO: 4246325

SEQ ID NO: 4247679 - RNA, 85 nt, Salmonella enterica enterica serovar Typhi Ty2; identical to SEQ ID NO: 4246498

SEQ ID NO: 4247680 - RNA, 64 nt, Salmonella enterica enterica serovar Typhi Ty2
cugacuaauuaucgcccucacuaaauacguuuuauucgauggugagggguuggugaugagugag

SEQ ID NO: 4247681 - RNA, 63 nt, Salmonella enterica enterica serovar Typhi Ty2; identical to SEQ ID NO: 4246359

SEQ ID NO: 4247682 - RNA, 77 nt, Salmonella enterica enterica serovar Typhi Ty2; identical to SEQ ID NO: 4245774

SEQ ID NO: 4247683 - RNA, 127 nt, Salmonella enterica enterica serovar Typhi Ty2; identical to SEQ ID NO: 4245836

SEQ ID NO: 4247684 - RNA, 78 nt, Salmonella enterica enterica serovar Typhi Ty2
gcgccgcuucgcgucuuauccggccuacgagugagcaucuguuuacacgccggauaaggcgcagccgccauccggcgc

SEQ ID NO: 4247685 - RNA, 73 nt, Salmonella enterica enterica serovar Typhi Ty2; identical to SEQ ID NO: 4245962

SEQ ID NO: 4247686 - RNA, 101 nt, Salmonella enterica enterica serovar Typhi Ty2
gccaucuggucgauucgcugcgucaggguggggcgaauauugauuaccuggagcaggaaaacuauccgccccugcgucugcgcggcgguuuuaucggcggc

SEQ ID NO: 4247687 - RNA, 101 nt, Salmonella enterica enterica serovar Typhi Ty2
gcggcgcguuucccaguugccgugauggucugaaaaacugagcaacuucucuuuauuuuucagaauaucaucuaccucagccuggaucgccucaucgccgc

SEQ ID NO: 4247688 - RNA, 56 nt, Salmonella enterica enterica serovar Typhi Ty2; identical to SEQ ID NO: 4246369

SEQ ID NO: 4247689 - RNA, 59 nt, Salmonella enterica enterica serovar Typhi Ty2
cgaugaguugcguuaccgcgaagaaauucccuguuauugcgguaaacaaggcuguaucg

SEQ ID NO: 4247690 - RNA, 84 nt, Salmonella enterica enterica serovar Typhi Ty2
cgauggucgacagagaugaugauaucaagauaggcauuaaaucgacugcgaucuuguuuggucguuaugacacauugauuaucg

SEQ ID NO: 4247691 - RNA, 76 nt, Salmonella enterica enterica serovar Typhi Ty2
augcaggccggauaaggcgaagccgccauccggcggugcagguugccugauggcgcugcgcuuaucaggccuacau

SEQ ID NO: 4247692 - RNA, 71 nt, Salmonella enterica enterica serovar Typhi Ty2
gccggagcgacagggucuguugugaaguuuauggggauuuucugccucacacagauuccugucgcuauugc

SEQ ID NO: 4247693 - RNA, 75 nt, Salmonella enterica enterica serovar Typhi Ty2
cugcugaauguccgacucaaacugaaaucgugcugaaaggcgcugauaagcaggugaucggccagguugcagcag

SEQ ID NO: 4247694 - RNA, 80 nt, Salmonella enterica enterica serovar Typhi Ty2
gggccauacaguuugugagcggaaaaagcauaaaaaucgauaucaagcugcuggacauccgccgggaaguguacagcgcc

SEQ ID NO: 4247695 - RNA, 77 nt, Salmonella enterica enterica serovar Typhi Ty2; identical to SEQ ID NO: 4245791

SEQ ID NO: 4247696 - RNA, 58 nt, Salmonella enterica enterica serovar Typhi Ty2
cgucgagcagauaaaaacgauugcggauuucaccgccaaugaucguuuuaugucggcg

SEQ ID NO: 4247697 - RNA, 79 nt, Salmonella enterica enterica serovar Typhi Ty2; identical to SEQ ID NO: 4246450

SEQ ID NO: 4247698 - RNA, 58 nt, Salmonella enterica enterica serovar Typhi Ty2; identical to SEQ ID NO: 4246462

SEQ ID NO: 4247699 - RNA, 98 nt, Salmonella enterica enterica serovar Typhi Ty2
ugccaguuguugauucaggcagugaagauucgcgguacggagggggugaauguucuuucacuugccgauggcauuuuccuguggauggaagaguggca

SEQ ID NO: 4247700 - RNA, 59 nt, Salmonella enterica enterica serovar Typhi Ty2; identical to SEQ ID NO: 4227440

SEQ ID NO: 4247701 - RNA, 130 nt, Salmonella enterica enterica serovar Typhi Ty2; identical to SEQ ID NO: 4246617

SEQ ID NO: 4247702 - RNA, 68 nt, Salmonella enterica enterica serovar Typhi Ty2
uggcugcauauuuaauuucuucgcuggguauuucaggauguaguugaauuugccugaugacauagcca

SEQ ID NO: 4247703 - RNA, 72 nt, Salmonella enterica enterica serovar Typhi Ty2; identical to SEQ ID NO: 4245940

SEQ ID NO: 4247704 - RNA, 60 nt, Salmonella enterica enterica serovar Typhi Ty2
caucccuaaugccgguaccaucccugccgccauaauggccgccaucggcauauaggaaug

SEQ ID NO: 4247705 - RNA, 67 nt, Salmonella enterica enterica serovar Typhi Ty2
uguacgcauauggcggaucuggauuacggugacuugcgcgucuauccggguaacuaugaugaguaua

SEQ ID NO: 4247706 - RNA, 82 nt, Salmonella enterica enterica serovar Typhi Ty2
gccuauccguaauauggugaauaccguugaccgcauucgccgcggacaacuggauagccguguggaaggauuuaugcugggc

SEQ ID NO: 4247707 - RNA, 64 nt, Salmonella enterica enterica serovar Typhi Ty2
ucauccacguugaugugaacuauucagaccuguacaccggucugauugacgucaaucugggcga

SEQ ID NO: 4247708 - RNA, 60 nt, Salmonella enterica enterica serovar Typhi Ty2
gauaugcagcucauuggcggcgacaccacgcguggaccgcugucgaugacgcuggguauc

SEQ ID NO: 4247709 - RNA, 65 nt, Salmonella enterica enterica serovar Typhi Ty2
cccuguguccugugcgguaaucugcugcuaucgagaacgacagauaucgcuaacaguauauaugg

SEQ ID NO: 4247710 - RNA, 67 nt, Salmonella enterica enterica serovar Typhi Ty2; identical to SEQ ID NO: 4246651

SEQ ID NO: 4247711 - RNA, 61 nt, Salmonella enterica enterica serovar Typhi Ty2; identical to SEQ ID NO: 4246034

SEQ ID NO: 4247712 - RNA, 83 nt, Salmonella enterica enterica serovar Typhi Ty2
ggggcgaucguguaaugcgaucagauccgguagaucguuuuccugauacugccggccugguuucacacgagcgauaaugcccu

SEQ ID NO: 4247713 - RNA, 56 nt, Salmonella enterica enterica serovar Typhi Ty2
uucgcugaguucguucagcgucgccaccacuggcagacgaccgauaaacucaggaa

SEQ ID NO: 4247714 - RNA, 55 nt, Salmonella enterica enterica serovar Typhi Ty2; identical to SEQ ID NO: 4245798

SEQ ID NO: 4247715 - RNA, 67 nt, Salmonella enterica enterica serovar Typhi Ty2
gcgcgcacauuaaugucgucagcggcaauuucaccauugcgcagccgcugggcguugaugauggcgu

SEQ ID NO: 4247716 - RNA, 59 nt, Salmonella enterica enterica serovar Typhi Ty2
ucuucagcgccaaacgcgucuguguguugggcgcgggcagacuguuguugcgaugaaga

SEQ ID NO: 4247717 - RNA, 70 nt, Salmonella enterica enterica serovar Typhi Ty2
cgcgcaucggcgcuguuucgccaguacgauauggauuacugcugcggcggaaaacagacgcuggcgcgcg

SEQ ID NO: 4247718 - RNA, 83 nt, Salmonella enterica enterica serovar Typhi Ty2; identical to SEQ ID NO: 4246596

SEQ ID NO: 4247719 - RNA, 66 nt, Salmonella enterica enterica serovar Typhi Ty2
ggcgcgggcgacaauuuuccccuggcgaucaacggcgaucgcccgaacguuagucgcaccgcaguc

SEQ ID NO: 4247720 - RNA, 77 nt, Salmonella enterica enterica serovar Typhi Ty2; identical to SEQ ID NO: 4245805

SEQ ID NO: 4247721 - RNA, 82 nt, Salmonella enterica enterica serovar Typhi Ty2; identical to SEQ ID NO: 4246091

SEQ ID NO: 4247722 - RNA, 79 nt, Salmonella enterica enterica serovar Typhi Ty2
gguggguagcgauaaccugcugaugaucaaugcgcaugucgcacaugauuguacgguagguaaucgcuguauccucgcc

SEQ ID NO: 4247723 - RNA, 67 nt, Salmonella enterica enterica serovar Typhi Ty2; identical to SEQ ID NO: 4246082

SEQ ID NO: 4247724 - RNA, 130 nt, Salmonella enterica enterica serovar Typhi Ty2
aggugaugguguagaaaacggcgcagucaccgcgcauuuccgcgauaagcuccagaccuuuaacacaggccaucaucucauugcggcgaugcgcaggguugcugcugcuggcguuuaccacauccuccau

SEQ ID NO: 4247725 - RNA, 78 nt, Salmonella enterica enterica serovar Typhi Ty2; identical to SEQ ID NO: 4245768

SEQ ID NO: 4247726 - RNA, 79 nt, Salmonella enterica enterica serovar Typhi Ty2
uccacccuaaaacgacugcuucaucuggggagcuuugcauugagcaguuuuuucccacugauggcgcagcgucgcugga

SEQ ID NO: 4247727 - RNA, 90 nt, Salmonella enterica enterica serovar Typhi Ty2; identical to SEQ ID NO: 4246253

SEQ ID NO: 4247728 - RNA, 71 nt, Salmonella enterica enterica serovar Typhi Ty2; identical to SEQ ID NO: 4246357

SEQ ID NO: 4247729 - RNA, 63 nt, Salmonella enterica enterica serovar Typhi Ty2; identical to SEQ ID NO: 4246608

SEQ ID NO: 4247730 - RNA, 72 nt, Salmonella enterica enterica serovar Typhi Ty2
gauuaugguguggcgugugguuugccgugcagguaugauccuguucgcaaucgcauguuaugccacugaguc

SEQ ID NO: 4247731 - RNA, 65 nt, Salmonella enterica enterica serovar Typhi Ty2; identical to SEQ ID NO: 4245913

SEQ ID NO: 4247732 - RNA, 87 nt, Salmonella enterica enterica serovar Typhi Ty2
gccaccaacaccgaaguggucagcauugagcugccgcgcgauaccaaaggcggcgcgggccacgguucgcugauuauuuuaggcggu

SEQ ID NO: 4247733 - RNA, 82 nt, Salmonella enterica enterica serovar Typhi Ty2; identical to SEQ ID NO: 4245829

SEQ ID NO: 4247734 - RNA, 56 nt, Salmonella typhimurium LT2; identical to SEQ ID NO: 4246640

SEQ ID NO: 4247735 - RNA, 61 nt, Salmonella typhimurium LT2
aggcgaaagacaauaucucagguggggcgagcauuucagaccaggaauaucucuuuuuccu

SEQ ID NO: 4247736 - RNA, 75 nt, Salmonella typhimurium LT2; identical to SEQ ID NO: 4245958

SEQ ID NO: 4247737 - RNA, 89 nt, Salmonella typhimurium LT2
ccguauucucgccuaacaaagucaggguacguuuguacugcccugcgguaugcaguucaauaucaaugucuuuacuuuugagaaagcgg

SEQ ID NO: 4247738 - RNA, 82 nt, Salmonella typhimurium LT2; identical to SEQ ID NO: 4246091

SEQ ID NO: 4247739 - RNA, 118 nt, Salmonella typhimurium LT2
ggugaacaguuuuucgcgcagauccggguuguugauggcguccggcugacugguacugagccacagcaggacuggagccaucagcagauucuggucgccgcugaaauccucgaucacc

SEQ ID NO: 4247740 - RNA, 64 nt, Salmonella typhimurium LT2
gaaaugccgcguaaagcacgaacgggcggaauuugcccuucggaccaauuuuacgccgcgaguc

SEQ ID NO: 4247741 - RNA, 75 nt, Salmonella typhimurium LT2
cgauggaagcaccggaugaaauuguuagugaacguacccgugcgcuccuuuucaccguuuuaucccgcuuucuug

SEQ ID NO: 4247742 - RNA, 64 nt, Salmonella typhimurium LT2
uccgccuguacgcuacagcgguucaucaauuggcgcucaguugggggcgguuguggcaggggga

SEQ ID NO: 4247743 - RNA, 83 nt, Salmonella typhimurium LT2
caccaaugauuaucauuucaguuuugauacuuggauaucauguagucauaugauugagauugguaaugaugguuuauuucgug

SEQ ID NO: 4247744 - RNA, 81 nt, Salmonella typhimurium LT2
gcgcccgcgaacuggcgguacgcgcccccgccagagucgucuuuccugaugcgcuggacgaacgcgugcugaaagcggcgc

SEQ ID NO: 4247745 - RNA, 66 nt, Salmonella typhimurium LT2
gcuggcugggacuuaaaagcggcagcggaaggugaagcgccggaugccgauuuuggucccggcggc

SEQ ID NO: 4247746 - RNA, 121 nt, Salmonella typhimurium LT2
cgcauagccucucagggccggcggagagucaugcucagugccgaaaauggcgcuggaggaauagcgugcgaaugcgguacugagacagaacaggguuuccgccugcuucugugggguggcg

SEQ ID NO: 4247747 - RNA, 55 nt, Salmonella typhimurium LT2
uugaggaaugggcgaguauuugggggauuaccuuuaucucuaaccaggucuucaa

SEQ ID NO: 4247748 - RNA, 80 nt, Salmonella typhimurium LT2
ggcgguugaggggcgugagcagguggauauuaacgcugaacagcugcuguauauucccggcucaagcgcucguuccugcu

SEQ ID NO: 4247749 - RNA, 76 nt, Salmonella typhimurium LT2
ggcgagcgucgccuuuaaugaccuugaggcucaauggcugacacaguugcguaaggcauuacaaggcgauaccgcc

SEQ ID NO: 4247750 - RNA, 65 nt, Salmonella typhimurium LT2; identical to SEQ ID NO: 4246951

SEQ ID NO: 4247751 - RNA, 89 nt, Salmonella typhimurium LT2
gcggcguccaucgcccgucggaucgucaggaaaauucugaucuuuggcgaucagguucaccacguccagacgcaggccauccacgccgc

SEQ ID NO: 4247752 - RNA, 91 nt, Salmonella typhimurium LT2; identical to SEQ ID NO: 4246603

SEQ ID NO: 4247753 - RNA, 68 nt, Salmonella typhimurium LT2
guauagcccuguuguuuuuucaugucggcaguauggcgggcggaagaaaaauaacgagcgccaaauac

SEQ ID NO: 4247754 - RNA, 60 nt, Salmonella typhimurium LT2
guauccgacucaagguaaauggcguguagguucagccguuuugggccugggaucagacgc

SEQ ID NO: 4247755 - RNA, 65 nt, Salmonella typhimurium LT2; identical to SEQ ID NO: 4245801

SEQ ID NO: 4247756 - RNA, 72 nt, Salmonella typhimurium LT2; identical to SEQ ID NO: 4245940

SEQ ID NO: 4247757 - RNA, 77 nt, Salmonella typhimurium LT2; identical to SEQ ID NO: 4245791

SEQ ID NO: 4247758 - RNA, 77 nt, Salmonella typhimurium LT2
ugccggauggcgcuacgcuuauccggccuacaauuucuguucacauaggcccgauaagacgcagccgccaucgggcg

SEQ ID NO: 4247759 - RNA, 64 nt, Salmonella typhimurium LT2
uaugaagcgucuggaagguuaccguaacuucuguaacaagcuguggaacgccagccgcuuugug

SEQ ID NO: 4247760 - RNA, 106 nt, Salmonella typhimurium LT2
acugguuugauaagugauugaguccugaugauggaaaacgcgcugauaccguaauaaguaucagcgcguuuuuuuaucuauuucuuagcgccagcagaaaaccggu

SEQ ID NO: 4247761 - RNA, 100 nt, Salmonella typhimurium LT2
cgcagugcagcguauucguggggcgaugcuggaugaauuacgcagccgcgauugggugccgcguagcguccggcguaaugcccgcgaaguggcgcaggcg

SEQ ID NO: 4247762 - RNA, 106 nt, Salmonella typhimurium LT2
cacauccacgccgggauucgcuucaagcauauuacucagcccuugaccguagcgggcggcaaaugacucuaagggcugaguauuguucugcgguacggcgauugug

SEQ ID NO: 4247763 - RNA, 85 nt, Salmonella typhimurium LT2
gauuauagccaaauuccggccuggcauagaaauuuaacuuuagccguuuuuauucugucuaucgcuggaaugguggcaacugauu

SEQ ID NO: 4247764 - RNA, 56 nt, Salmonella typhimurium LT2; identical to SEQ ID NO: 4245784

SEQ ID NO: 4247765 - RNA, 60 nt, Salmonella typhimurium LT2; identical to SEQ ID NO: 4246013

SEQ ID NO: 4247766 - RNA, 84 nt, Salmonella typhimurium LT2
guaucgccguuuucgcaaauugccguugaugccauuagugcugacgccggcacugcugguguuaaugcugguguucggucauau

SEQ ID NO: 4247767 - RNA, 58 nt, Salmonella typhimurium LT2
gaaugccgaaugacgggccuacgcgcauguucuccguaggccccgccauccggcauuu

SEQ ID NO: 4247768 - RNA, 71 nt, Salmonella typhimurium LT2
cggugagcacauuuuagacuugugcgccgcgcccggcgguaaaaccacgcauauucucgaaguggcccccg

SEQ ID NO: 4247769 - RNA, 58 nt, Salmonella typhimurium LT2
uuuuggcaccauguuuagcaccacgguaucguggggcuaaaaaagcguggugcuaaaa

SEQ ID NO: 4247770 - RNA, 66 nt, Salmonella typhimurium LT2
ucugcaacgcguugcugaaccgguagaugacgaagaacucgacgcuaucgacggcagcguggcgga

SEQ ID NO: 4247771 - RNA, 65 nt, Salmonella typhimurium LT2
gcaggguagacaucagcucgccguggcugaccaguucaucggucagggcugccgaugucgccagc

SEQ ID NO: 4247772 - RNA, 82 nt, Salmonella typhimurium LT2
gccaguugggugucgacaauguugaugccaucgccgcaacggaaggcguugauggcauuuuugucggcccaagcgauuuggc

SEQ ID NO: 4247773 - RNA, 76 nt, Salmonella typhimurium LT2
uuuucgguuuuacuacccuggauacuuguauauucaacuucaacgguauugacauaauccggguaaagaccaaaga

SEQ ID NO: 4247774 - RNA, 68 nt, Salmonella typhimurium LT2
guuaucuucguugggcuggucgccauccuuauuuauaacaacguaaccagccacggagcgcagaugac

SEQ ID NO: 4247775 - RNA, 73 nt, Salmonella typhimurium LT2; identical to SEQ ID NO: 4246520

SEQ ID NO: 4247776 - RNA, 105 nt, Salmonella typhimurium LT2
guguccgugaccguuuggcgccaaccugcugugcagccacgguagcacguuguucaucugcugcuccaguuuccacggcggguuaaccacgaucauaccggacgc

SEQ ID NO: 4247777 - RNA, 64 nt, Salmonella typhimurium LT2; identical to SEQ ID NO: 4246336

SEQ ID NO: 4247778 - RNA, 60 nt, Salmonella typhimurium LT2; identical to SEQ ID NO: 4247222

SEQ ID NO: 4247779 - RNA, 56 nt, Salmonella typhimurium LT2; identical to SEQ ID NO: 4246605

SEQ ID NO: 4247780 - RNA, 82 nt, Salmonella typhimurium LT2
augucaccggugggcgcuuguaugcacauagccuggaacgcaucauucccggcuuugcggaucaggcccccauugaacgcau

SEQ ID NO: 4247781 - RNA, 70 nt, Salmonella typhimurium LT2
gcugguagaagugccgguuggcuucaaaugguuuguugacgguuuguucgacggcagcuuugguuucggc

SEQ ID NO: 4247782 - RNA, 60 nt, Salmonella typhimurium LT2
aaaccagguugcgguugauggucugaauggccucgaaaauagauuuuuguauccggguuu

SEQ ID NO: 4247783 - RNA, 82 nt, Salmonella typhimurium LT2
ucgccgcuaucagcgguuuuauuuacguugcucugggcgcguucggggcgcauguuuugaguaaaacccugggcgugguuga

SEQ ID NO: 4247784 - RNA, 66 nt, Salmonella typhimurium LT2
gccguccauauagguuucgauuucggugacccggcauugcacuaagucgagcucaauaugguuggc

SEQ ID NO: 4247785 - RNA, 78 nt, Salmonella typhimurium LT2
gcgcugaaacugcuugaugaggccgaacgucugggaucgacaucugcccguuccaccuuuaucagcaguguaaaaggc

SEQ ID NO: 4247786 - RNA, 62 nt, Salmonella typhimurium LT2; identical to SEQ ID NO: 4245944

SEQ ID NO: 4247787 - RNA, 65 nt, Salmonella typhimurium LT2; identical to SEQ ID NO: 4246379

SEQ ID NO: 4247788 - RNA, 55 nt, Salmonella typhimurium LT2; identical to SEQ ID NO: 4246315

SEQ ID NO: 4247789 - RNA, 98 nt, Salmonella typhimurium LT2
gguaacuguaaaaauguaggccugauaagcgcagcgccaucaggcaaccugcaccgccggauggccgcuucgccuuauccggccuacaugcacuuauc

SEQ ID NO: 4247790 - RNA, 61 nt, Salmonella typhimurium LT2
cgggcgcguucuccuaccugcauggccugcugcucgccuuuugcugucaggggacuguccg

SEQ ID NO: 4247791 - RNA, 73 nt, Salmonella typhimurium LT2
cagugaaccuuauguuccucuccugaaacaggaauauacuccucgucaggaaaaccaacaugauguauaucug

SEQ ID NO: 4247792 - RNA, 80 nt, Salmonella typhimurium LT2
cgguaaaaugcggcgauuuuucucgauaacgcccgguucuuuggucaacugaccguuaucgucgaaaccgccguccaccg

SEQ ID NO: 4247793 - RNA, 63 nt, Salmonella typhimurium LT2
uguacucggccacagcgggaaugagcgguacaaaaccgaucguuuccguucuggaugaaguca

SEQ ID NO: 4247794 - RNA, 55 nt, Salmonella typhimurium LT2
gcgcuacgcgcagauaggcugcgucaugaugacgcaugacuaucugcgcuggugc

SEQ ID NO: 4247795 - RNA, 77 nt, Salmonella typhimurium LT2; identical to SEQ ID NO: 4245890

SEQ ID NO: 4247796 - RNA, 99 nt, Salmonella typhimurium LT2
aucuauauuuuguauagcgcguuacguaugggguaugaggcggugcagucauuauuggaucgcgcgcugcccgaugcggaacgacaggaaauuauugau

SEQ ID NO: 4247797 - RNA, 83 nt, Salmonella typhimurium LT2
uggcgucgcugugcaagguuugacgcuggagauuggaaacggaaacgguaucaaaaucgaguagcgucaguugcccgacgcca

SEQ ID NO: 4247798 - RNA, 62 nt, Salmonella typhimurium LT2
augugagagauaucggauuuuacuuauugauuuauaagaaaaaacuccgaaauuucuugcgu

SEQ ID NO: 4247799 - RNA, 81 nt, Salmonella typhimurium LT2
cugguaaucaaacagcaucgucggcuggguggcgagcaggcagucgagccgucugaccggaugaugcguuucaauuaccag

SEQ ID NO: 4247800 - RNA, 72 nt, Salmonella typhimurium LT2
uguucaaugccagggucgcccagggucacgaaggggacaaaagcgccuucccggcgaucguugaguugggca

SEQ ID NO: 4247801 - RNA, 61 nt, Salmonella typhimurium LT2
ucgguugcggaaaguguggcgaggcggauaguaccguaaucaaccacgccgccgccgcuga

SEQ ID NO: 4247802 - RNA, 91 nt, Salmonella typhimurium LT2
uuauugccgcuaucgguuuugaggugauuaaaaucauuaugacuuauacgcugccgucacuggugaaaucgccuuccggcgcggcguuugg

SEQ ID NO: 4247803 - RNA, 94 nt, Salmonella typhimurium LT2
gaagcuacgauaaaagagguucaugaugcgccugcaguacggggaaguaucaucgcuaacaugcuacaggagcaugauaacccuuuuacgcuuu

SEQ ID NO: 4247804 - RNA, 72 nt, Salmonella typhimurium LT2
cacaggccaugaguggcaugaagauuucauagcucucugagagaaauaugugauccaucgugacuaucugug

SEQ ID NO: 4247805 - RNA, 66 nt, Salmonella typhimurium LT2
ccgaggugucaacggccaguagauccugaaugaaaaucucacugcucggcuuguuggucaguucgg

SEQ ID NO: 4247806 - RNA, 60 nt, Salmonella typhimurium LT2; identical to SEQ ID NO: 4245876

SEQ ID NO: 4247807 - RNA, 72 nt, Salmonella typhimurium LT2
ugugcuggcaguacgccggaagucaugaauaacaaaaucccugacguucagauccagcguacgcaccgcaca

SEQ ID NO: 4247808 - RNA, 69 nt, Salmonella typhimurium LT2
uauggcgcgggggaaaagauggucgauauccuuauccguaucgcguuaaucuuauucuucuccgccgug

SEQ ID NO: 4247809 - RNA, 59 nt, Salmonella typhimurium LT2
caccuuccaccagcgcuuugguggauucacgguaggccgccaccagcugaucgaaggug

SEQ ID NO: 4247810 - RNA, 76 nt, Salmonella typhimurium LT2
ucaucgaaccaggaaucguuaacgucgggaagcucauccaacaucucgucaauguucgguuccuggguggugaugg

SEQ ID NO: 4247811 - RNA, 70 nt, Salmonella typhimurium LT2
ggugcauguucgggacuugcuggcuaccaggacaaacucugauucaaacagcggcucgacaugcagaucc

SEQ ID NO: 4247812 - RNA, 62 nt, Salmonella typhimurium LT2
aagauccugcaaugcgcugacgccgccuucgaucaucguggcggcggugcuuugcagaucuu

SEQ ID NO: 4247813 - RNA, 62 nt, Salmonella typhimurium LT2
cuuaucugcaauaaagguugcccgucguucgcguaugggcgcgaucaguucuugcaggcagg

SEQ ID NO: 4247814 - RNA, 70 nt, Salmonella typhimurium LT2; identical to SEQ ID NO: 4246408

SEQ ID NO: 4247815 - RNA, 64 nt, Salmonella typhimurium LT2
gccaauaaguuggucugacuuaauucugaucgugacagucugagcaagugacagacuuauuggu

SEQ ID NO: 4247816 - RNA, 79 nt, Salmonella typhimurium LT2
gguugaggcgcgggcgacaauuuuccccuggcgaucaacggcgaucgcccgaacguuugucgcaccgcagucgagaacc

SEQ ID NO: 4247817 - RNA, 90 nt, Salmonella typhimurium LT2
gggugcaggaauuuuaucagcggcguguucccgacgcuugccaguugcagcgucucaauacguugcuccuguaaauacuuacuggcgccc

SEQ ID NO: 4247818 - RNA, 84 nt, Salmonella typhimurium LT2
gucugggugguuggcgauauucacggcuguuuuucaauguuaaugaaaagguuacgugagugucgauuugauccgcaacaagac

SEQ ID NO: 4247819 - RNA, 77 nt, Salmonella typhimurium LT2; identical to SEQ ID NO: 4247042

SEQ ID NO: 4247820 - RNA, 55 nt, Salmonella typhimurium LT2
guaaaacagugcacaucaccuuuuaaaauccagggaugugccaugauugauuuac

SEQ ID NO: 4247821 - RNA, 88 nt, Salmonella typhimurium LT2; identical to SEQ ID NO: 4246259

SEQ ID NO: 4247822 - RNA, 77 nt, Salmonella typhimurium LT2
cguggcuaccggugcugucgguguagcccaccacauugacggcggucuugggauacucuuucagcaccaucgccacg

SEQ ID NO: 4247823 - RNA, 78 nt, Salmonella typhimurium LT2
aaucauaacugaaaauucucgccggacuggaaaauugacaaauuugugccauuccugagcaauuacgugguagugauu

SEQ ID NO: 4247824 - RNA, 75 nt, Salmonella typhimurium LT2
uggcaacgcucuauccggcucgcgcuaucggcguugauaaacaucucgguagcauugcgccggguaaagucgcca

SEQ ID NO: 4247825 - RNA, 78 nt, Salmonella typhimurium LT2
gcuaacaggguaaguucuuuucuuaauuaccagucgacauucacuguaugguuauaaaaaggaugcugauccuuuagc

SEQ ID NO: 4247826 - RNA, 71 nt, Salmonella typhimurium LT2
gcguugaauggauugagcguuuacuggagucgggcgugcgcacgauccaguugcguaucaaagauaaacgc

SEQ ID NO: 4247827 - RNA, 85 nt, Salmonella typhimurium LT2
gcccggauugacucgccagcuuaagugguggaggauagggcgaucguuauacgagacuacuccaucguuaaguacgauccguggu

SEQ ID NO: 4247828 - RNA, 91 nt, Salmonella typhimurium LT2
uccggcgugacgauagagcaacugguucugguggauacggccgaagcgccggacggugaaccggagccagugucugucacggcaccacgga

SEQ ID NO: 4247829 - RNA, 84 nt, Salmonella typhimurium LT2
ugauaacucacgccccggauagagauaucgccauugcacuuugauauugacuguaaugccgguguuuuuucugccugaucuuca

SEQ ID NO: 4247830 - RNA, 66 nt, Salmonella typhimurium LT2; identical to SEQ ID NO: 4245934

SEQ ID NO: 4247831 - RNA, 116 nt, Salmonella typhimurium LT2
gagcacauuaaugaacaugguguuacgugauuugagcggcuggcguugugaaaaauugaccgaacauagcgccgugcugcaucugaaugcauuuacccagguuaucugccaugcuc

SEQ ID NO: 4247832 - RNA, 99 nt, Salmonella typhimurium LT2
cggacuguuugcuuauaaucuggccgugguggucgacgaucauuuucagggggugacggagaucguccgcggcgcagauuuaaucgaacccacuguccg

SEQ ID NO: 4247833 - RNA, 60 nt, Salmonella typhimurium LT2; identical to SEQ ID NO: 4245963

SEQ ID NO: 4247834 - RNA, 76 nt, Salmonella typhimurium LT2
ggcgugaaugccuuauccggccuaccgaucgcgccaugucaauaagcgaacguguaggccugguaagcgaagcgcc

SEQ ID NO: 4247835 - RNA, 55 nt, Salmonella typhimurium LT2
cucgcgcuuaacaguacguuggguaaaccuaucccgacgucgccggaaagcguag

SEQ ID NO: 4247836 - RNA, 56 nt, Salmonella typhimurium LT2
augugggauuacuucgaugggaucuuguaaaucaacaucgauagggaucaccacau

SEQ ID NO: 4247837 - RNA, 66 nt, Salmonella typhimurium LT2
gcggcuguuucccggccaucccaucagcgagaaaaaagcgcugcugcagccgggacaauacgccgc

SEQ ID NO: 4247838 - RNA, 76 nt, Salmonella typhimurium LT2
accgccuuuuaucgccaucguguuaauacucaaucaggugauugauguggguaaauugaugggggcauugggcggu

SEQ ID NO: 4247839 - RNA, 83 nt, Salmonella typhimurium LT2
aguugcagcggauuauuuuuucgcuugagcgcgaggcccgagaaagagcgaauaaagugcgagaauaaucuucacgcuaaacu

SEQ ID NO: 4247840 - RNA, 86 nt, Salmonella typhimurium LT2
gucuggaugaguucgaaaccgucgguaacaccauccgugccuuugcaucggauaacgccaccgugguuaucgguacuucucuggac

SEQ ID NO: 4247841 - RNA, 73 nt, Salmonella typhimurium LT2
gauccgcuaucgcgugauaaagcgcugacccagcuccaugcggggaucgaucgcgccacgcgacuggucgauc

SEQ ID NO: 4247842 - RNA, 97 nt, Salmonella typhimurium LT2
uuggcaauggucuuguagcguucgcccgucagcacguugagcaccgccugggugccgacaaucugcgaggugggggucaccagcgggauaaagccga

SEQ ID NO: 4247843 - RNA, 56 nt, Salmonella typhimurium LT2; identical to SEQ ID NO: 4246754

SEQ ID NO: 4247844 - RNA, 59 nt, Salmonella typhimurium LT2
gcgauauggcugucgcccgugccggcaaacuugccgccguaagcgcgauaguuauucgu

SEQ ID NO: 4247845 - RNA, 80 nt, Salmonella typhimurium LT2
ugucgcugcugggaauugaagcguugcuugaucgccugccggggagcuuguccggcggagaaaaacagcgcguagcgaua

SEQ ID NO: 4247846 - RNA, 61 nt, Salmonella typhimurium LT2; identical to SEQ ID NO: 4246418

SEQ ID NO: 4247847 - RNA, 94 nt, Salmonella typhimurium LT2
cuuuacacagcugcggcaccuugcgggacagcuugucgauaucacucauggugaagucgauuuccgcuuccugcgccgccgccagcaggugaag

SEQ ID NO: 4247848 - RNA, 68 nt, Salmonella typhimurium LT2; identical to SEQ ID NO: 4228091

SEQ ID NO: 4247849 - RNA, 62 nt, Salmonella typhimurium LT2
gcucgacuggacggacagacauugccgcuauuuccugcguuugcugucucgccagacgcagc

SEQ ID NO: 4247850 - RNA, 121 nt, Salmonella typhimurium LT2
gccagaaggugguucugugcucgccgccgcccaucgcugaugaaauccucuaugcggcgcaacuguguggcgugcaggaaaucuuuaacgucggcggcgcgcaggcgauugccgcucuggc

SEQ ID NO: 4247851 - RNA, 75 nt, Salmonella typhimurium LT2
ugucgagaccugucaucuuccuuaugcuugugcucugcucacaggagggauuuauggcuggcuggcaucuugaua

SEQ ID NO: 4247852 - RNA, 69 nt, Salmonella typhimurium LT2; identical to SEQ ID NO: 4246464

SEQ ID NO: 4247853 - RNA, 64 nt, Salmonella typhimurium LT2
uugugcgucgggcgcuggucgccuuuuuggguauuuugcugcugaccggcguacugaucgccaa

SEQ ID NO: 4247854 - RNA, 87 nt, Salmonella typhimurium LT2
guuccuuguaggccggauaaggcggagccgccauccggcagugccgguugccugauggcgcugcgcuuaucaggccuacgguuuuac

SEQ ID NO: 4247855 - RNA, 57 nt, Salmonella typhimurium LT2
ucuccguucgcuaugcgcugacggacuggguuuacggacggugccugguggcggaga

SEQ ID NO: 4247856 - RNA, 130 nt, Salmonella typhimurium LT2
cuuaccguaugcaaaaggcaccucgaccagacugauaagacugauauccaucggagggggagugcuguuccucgggggggcguuuuaucucuuuugcuucaauagguuggcuuuuuuaugcuguagugag

SEQ ID NO: 4247857 - RNA, 72 nt, Salmonella typhimurium LT2
agggcgcggacuucuaguccggcuugggucuggugcauuccgaguacggaaaaaggguccgcaaaauguccu

SEQ ID NO: 4247858 - RNA, 70 nt, Salmonella typhimurium LT2
ccgggucgaggaucgccauauccggauacagcgcauuguugaacagcggauacuugaugccuuuauccgg

SEQ ID NO: 4247859 - RNA, 75 nt, Salmonella typhimurium LT2
ggaauuucgcugccuugcuugauacuggcuggcuguagaugcgaagccagcagccgggggcuggcgauaauaucc

SEQ ID NO: 4247860 - RNA, 68 nt, Salmonella typhimurium LT2
ccgaccgugagaaucgaucagcuuaaagggauuaucagaaggcuugauacugaggauuuucgcgucgg

SEQ ID NO: 4247861 - RNA, 67 nt, Salmonella typhimurium LT2
guuucgucgaagaugacggcuuugccgucgcgccagcuauggcgcugucgaucaacuucaauaaaac

SEQ ID NO: 4247862 - RNA, 57 nt, Salmonella typhimurium LT2
agcugauggagcuggugggggaagaugacauucugauccugaccgcugaccacggcu

SEQ ID NO: 4247863 - RNA, 73 nt, Salmonella typhimurium LT2
gaccagcguugaucugguaguuauugcgaucgucaaugcgcucguaauagccgaccugauugcuguuguuguc

SEQ ID NO: 4247864 - RNA, 68 nt, Salmonella typhimurium LT2
uauuaccgucgauacugcugacuuuaagcagcaucgugcgcaccgucagaucgguaucgccggugaug

SEQ ID NO: 4247865 - RNA, 77 nt, Salmonella typhimurium LT2
gacgacuugauguauaccguuugcuauacauggugguugugcuauucuuguaaagcaaaugcuauacaagggguguc

SEQ ID NO: 4247866 - RNA, 58 nt, Salmonella typhimurium LT2; identical to SEQ ID NO: 4245968

SEQ ID NO: 4247867 - RNA, 80 nt, Salmonella typhimurium LT2
gccugauggcacugcgcuuauccggucuacguaaugcauagcgucuguaggccggguaaggcguuucgccgccauccggc

SEQ ID NO: 4247868 - RNA, 99 nt, Salmonella typhimurium LT2
ggguaugcgcuuguuccauuuaucuuuccugacgacgggucuguaggcaguauacuaccaccacgcguggaaaugauguaccggaccaaugcccuuccc

SEQ ID NO: 4247869 - RNA, 110 nt, Salmonella typhimurium LT2
cgugaguuucccgauugauaucgaggcguugaaguucuggaaucagcagaugaaauaugacgcggaacccggcaaguucaacgucuuuaucggcguggauuccgcucgcg

SEQ ID NO: 4247870 - RNA, 65 nt, Salmonella typhimurium LT2
accaccgucauccccuggguguauuuccccuggguuuccacgccgacccaacgcucaacgguggu

SEQ ID NO: 4247871 - RNA, 69 nt, Salmonella typhimurium LT2; identical to SEQ ID NO: 4245922

SEQ ID NO: 4247872 - RNA, 70 nt, Salmonella typhimurium LT2
ucgcuggacgccgugauuacggcgguagguaugguaaaccaucugccgguuaugauggcggcggugguga

SEQ ID NO: 4247873 - RNA, 66 nt, Salmonella typhimurium LT2
gcuaaaggugacguugauggugcagguuuuaaugguaacaaucugaacauuaagucauggaauggu

SEQ ID NO: 4247874 - RNA, 65 nt, Salmonella typhimurium LT2
ggacuguuuaucgcuauuauuacaaggguuaauaaccaacaaugaacagugaugaaaacgagucc

SEQ ID NO: 4247875 - RNA, 96 nt, Salmonella typhimurium LT2
cccgcucaauaucuucgucaacguggcguugguguucauggcgcugaugcacgguaugcaacuggcgcugcugaaaucaacgauaccgaaagcggg

SEQ ID NO: 4247876 - RNA, 68 nt, Salmonella typhimurium LT2
guugccccaggguuugacguuuccacuucgccagugaaugcaccacuucgaacugggcgucaggcaau

SEQ ID NO: 4247877 - RNA, 81 nt, Salmonella typhimurium LT2
uugcgcuuagcaacgguaauacugucagucugacgccgcaggcgcagguugucuggcagaauuacucagcggauagcguga

SEQ ID NO: 4247878 - RNA, 63 nt, Salmonella typhimurium LT2
ucuccguuuccgacuacggcgacggcuggauagaucugcugauucguaaugucggaaaaguga

SEQ ID NO: 4247879 - RNA, 85 nt, Salmonella typhimurium LT2; identical to SEQ ID NO: 4246156

SEQ ID NO: 4247880 - RNA, 84 nt, Salmonella typhimurium LT2
ucuucuguuccuuucuguuugcgaugccgcuggccuucuacuacaucuucgcuaacggcuaucugacagaaguaggaaugaaga

SEQ ID NO: 4247881 - RNA, 64 nt, Salmonella typhimurium LT2
agaauauauucuuguugugguauuuauugcuauugauaagcgucagacacagagaauauauuuu

SEQ ID NO: 4247882 - RNA, 71 nt, Salmonella typhimurium LT2
ccggcgaugcgguucaucaacguuaugugguugauaccaaaggagucuggcgcugaugaaacgcauucugg

SEQ ID NO: 4247883 - RNA, 109 nt, Salmonella typhimurium LT2
gacggaguaacggauugcccgauggagcuacgcuuaucgggccuacgauucucaauuauuuguaggcuggauaaggcguaagccgcauccggcacugaguauuacuguu

SEQ ID NO: 4247884 - RNA, 83 nt, Salmonella typhimurium LT2
gcccguugcugaaugacgcugcgcuuauucggccugugaguuaugccggauaagcccuuagcgucgcugcccggcaacauggc

SEQ ID NO: 4247885 - RNA, 84 nt, Salmonella typhimurium LT2
ccaucauggcgagcgaguacaaagugcaguugcccgacgaaaaauuacucacagacgaacuuauucguucgcaaaccaugcugg

SEQ ID NO: 4247886 - RNA, 76 nt, Salmonella typhimurium LT2
gcggcgugaaagucacuuccgugaacauuggcgguauggccuaucgucaagguaaaacgcaggugaacaacgccgu

SEQ ID NO: 4247887 - RNA, 86 nt, Salmonella typhimurium LT2
augacccgcacgacuccggcguuauccggcaacguaacggucgggauaacaucguggguaaugcuuugauaacccgggguggucau

SEQ ID NO: 4247888 - RNA, 82 nt, Salmonella typhimurium LT2
cgggcgccaucauugccggugguaaaggcacugcggaugaaaaauucgcagcgcuggaagccgcgggcgugaaaaccguucg

SEQ ID NO: 4247889 - RNA, 65 nt, Salmonella typhimurium LT2; identical to SEQ ID NO: 4246012

SEQ ID NO: 4247890 - RNA, 71 nt, Salmonella typhimurium LT2
gcgccucaggagguggugagcgcuauucguucgguguauuccggacaacguuauaucgccuccgauaucgc

SEQ ID NO: 4247891 - RNA, 78 nt, Salmonella typhimurium LT2
gccggauggcgacguguuacgccuuauccggccuacagauauauccccguaggccugauaagcguagcgccgccgggc

SEQ ID NO: 4247892 - RNA, 84 nt, Salmonella typhimurium LT2
ggcgaagagcuggaaacgcugugucaugccgguauuccuuucucgguagugccggggauuaccgcggcuuccggcugcuccgcc

SEQ ID NO: 4247893 - RNA, 74 nt, Salmonella typhimurium LT2
agauuucguggugauugauguugguguguacguucaugaugucuuugcgcacuuuaaucgccaugaucacuucu

SEQ ID NO: 4247894 - RNA, 73 nt, Salmonella typhimurium LT2; identical to SEQ ID NO: 4246443

SEQ ID NO: 4247895 - RNA, 62 nt, Salmonella typhimurium LT2
gccgugagauguucgcguucuucuucccgaucguuauuaagcagacugcggaccgucgcggc

SEQ ID NO: 4247896 - RNA, 74 nt, Salmonella typhimurium LT2
gggauguuccggacgacaaacgccaggcgcgauuccauuguguacugguuuauuugcgucaugcggaagauccc

SEQ ID NO: 4247897 - RNA, 78 nt, Salmonella typhimurium LT2
cgcuuuuaacaugcggcuagccgggaacaaauucaccaucuaaaaagaguuuuccguuuuccgcaugcauaacgagcg

SEQ ID NO: 4247898 - RNA, 76 nt, Salmonella typhimurium LT2
gucugccacucgccgcgcgaacggacgccugucgcguaaaccugcguaggcgugcccgcgcaggccucuaccagac

SEQ ID NO: 4247899 - RNA, 90 nt, Salmonella typhimurium LT2
cagggagagcgaauugugaucgcuaaaacguuuuuauguuaacgccuuuaauaucaaagcauuguuagugauggcaauuuggcgccgcug

SEQ ID NO: 4247900 - RNA, 112 nt, Salmonella typhimurium LT2
gcauuuacguuugugagguaaauuacgaguuaauugcaaccugcgcaaugauacuuugaucauugagugcgauuacgcucaacacauuaucauccagaauaccguagcuugc

SEQ ID NO: 4247901 - RNA, 58 nt, Salmonella typhimurium LT2
gcgcccuuaugcguuuaccugugcacaauaaacaaacagguuuaccgugauggagcgu

SEQ ID NO: 4247902 - RNA, 89 nt, Salmonella typhimurium LT2
gcggcguggauggccugcgucuggacguggugaaccugaucgccaaagaucagaauuuuccugacgauccgacgggcgauggacgccgc

SEQ ID NO: 4247903 - RNA, 61 nt, Salmonella typhimurium LT2
acgccguggcgagagacuuucgcgacugccgccggcaguugacgguuuuucgccagcgcgu

SEQ ID NO: 4247904 - RNA, 93 nt, Salmonella typhimurium LT2
cgacauaucccgcagcgaccuguuuguugccggguugcaggaaaucuucuucggugaccggcgugccgacgggcgucacgcggcgauaaaucg

SEQ ID NO: 4247905 - RNA, 65 nt, Salmonella typhimurium LT2
ccgaguuuaucuuucaggcguucaagacgaacagaguuccguugcccgucuggcaggaaacgcgg

SEQ ID NO: 4247906 - RNA, 79 nt, Salmonella typhimurium LT2
auaaucuauuguuucuuuuucccugcgauuugucauccucccugagacaaaguuuuaccagaagaagcguggcuguuau

SEQ ID NO: 4247907 - RNA, 83 nt, Salmonella typhimurium LT2; identical to SEQ ID NO: 4247575

SEQ ID NO: 4247908 - RNA, 59 nt, Salmonella typhimurium LT2
uccgcucuggacccugaacugcgccaugaagugcugaaagucaugcaggaucuggcgga

SEQ ID NO: 4247909 - RNA, 58 nt, Salmonella typhimurium LT2
caauccggucaguuccacaccguuagagcuaccuuugcggauacgaauuaccguuuug

SEQ ID NO: 4247910 - RNA, 96 nt, Salmonella typhimurium LT2
ggcgucauggcaggcaccuggcugcugacgguccuguuaagcgguuauucaucguuaggggcgauugucagcgccuugauugcgccguuuuacguc

SEQ ID NO: 4247911 - RNA, 66 nt, Salmonella typhimurium LT2
uggcugauaucuggcccagguccgauaagcguagcgccaucaggcagguuugccggauaucagcca

SEQ ID NO: 4247912 - RNA, 106 nt, Salmonella typhimurium LT2
agguaguguuuaagcgucaggcgaagcuccgggcucauauuaucaagguuauuaaaaagccagcguaaauagcccggaucgcguuuugcgacuucagauaccgccu

SEQ ID NO: 4247913 - RNA, 86 nt, Salmonella typhimurium LT2
uacuagaggaggcgcuagaaaguuuucuaccgauccuagagacuucuaggaucgguagaaaacuuucuagcgcaacccuaaaagua

SEQ ID NO: 4247914 - RNA, 55 nt, Salmonella typhimurium LT2
uuccggcgagagaaacuuguuagcgccuuugaugaucagaaugcuguugcuggag

SEQ ID NO: 4247915 - RNA, 59 nt, Salmonella typhimurium LT2; identical to SEQ ID NO: 4246263

SEQ ID NO: 4247916 - RNA, 63 nt, Salmonella typhimurium LT2; identical to SEQ ID NO: 4246930

SEQ ID NO: 4247917 - RNA, 55 nt, Salmonella typhimurium LT2
gguggcauggcuugccgguccggaagccucuuucgucaccggcgcgaugcacacc

SEQ ID NO: 4247918 - RNA, 68 nt, Salmonella typhimurium LT2
cgccgcaggaauacauaggacaccaucugaauaaccuucaguuggaccugcguacuuucucgcuggug

SEQ ID NO: 4247919 - RNA, 60 nt, Salmonella typhimurium LT2
ggcgaaaucaucgccacccaucucgccggggcaggcgacauggucacgaugauuauugcc

SEQ ID NO: 4247920 - RNA, 60 nt, Salmonella typhimurium LT2
ggaaugcaacgccugauuugccuuuucguuuuuuuccggggcgucaugcggcugcguuuc

SEQ ID NO: 4247921 - RNA, 79 nt, Salmonella typhimurium LT2; identical to SEQ ID NO: 4245797

SEQ ID NO: 4247922 - RNA, 64 nt, Salmonella typhimurium LT2
ggauugccauuggacuugccgggauuauucugcugaacagcggcggcaacuuaagcggcaaucc

SEQ ID NO: 4247923 - RNA, 74 nt, Salmonella typhimurium LT2
guaugaugcugucuggucagcguggagaagggcugcacccgcagaagagucacgcggccgugcagcagugguac

SEQ ID NO: 4247924 - RNA, 78 nt, Salmonella typhimurium LT2
uguugcauccugcugggagcaggcucgauuuauggccuuuaucgcuauauugagccacagcuaccugacgucgcgaca

SEQ ID NO: 4247925 - RNA, 112 nt, Salmonella typhimurium LT2
cggcgguauugugcguaccaucgcgauggggucuucugacggucugcgucgcggucuggauguaaaagaucucgaacacccgaucgaagucccgguagguaaagcuacgcug

SEQ ID NO: 4247926 - RNA, 129 nt, Salmonella typhimurium LT2
cauaucgacuggcaggcgaucggcgaaauacgccagcgucugacuauuccgguuaucgcgaauggcgaaaucuuggacuggcagagcgcgcaggcauguauggcgaccagcggcugcgaugcggugaug

SEQ ID NO: 4247927 - RNA, 116 nt, Salmonella typhimurium LT2
gacguauggcgguaauuaaugagucguugcacccgccgauggauagccgugugcgcgaugccugccaguauaucagcgaccaucuggcggacagccauuuugauaucgccagcguc

SEQ ID NO: 4247928 - RNA, 64 nt, Salmonella typhimurium LT2
uacaggcggaauaaguagauaagcaauacugcggaaaucagauugcucaacguauucgccagua

SEQ ID NO: 4247929 - RNA, 77 nt, Salmonella typhimurium LT2
gcgcugcgaggugucgcuuugaugaccuuugcgcauccagucgacgcgcaccaucggauagcgaauacgcgccgcgu

SEQ ID NO: 4247930 - RNA, 104 nt, Salmonella typhimurium LT2
gccggguuuacccggugaggcgcaauguugcggggguuugauccccggcggcauagguugcuggauagagaaaacccccgcacguugacugguauaaaccuggc

SEQ ID NO: 4247931 - RNA, 60 nt, Salmonella typhimurium LT2
gguaagaaacgcaugaagcagaucgguaacgucgagcugccucaggaagcguuccucgcc

SEQ ID NO: 4247932 - RNA, 86 nt, Salmonella typhimurium LT2
caacagcaggcaucgguucugcgacauaguugaaguucucaucgcuauuccagcuaccucgcggaucgucgccuugcgacauguug

SEQ ID NO: 4247933 - RNA, 119 nt, Salmonella typhimurium LT2
guggcguaauucaucgcuggcuucggugaguuggauaguggcuucuuccagcauauccaggaugccggaaagcuugcuguccauaccuaccagcucgcuaaccaguuguuuugcgcuau

SEQ ID NO: 4247934 - RNA, 61 nt, Salmonella typhimurium LT2; identical to SEQ ID NO: 4246021

SEQ ID NO: 4247935 - RNA, 80 nt, Salmonella typhimurium LT2
ucaccccuugaauauucuuucuaacagguauacuguguuuauauacagugguugaauguagagggaauuaugagaauuga

SEQ ID NO: 4247936 - RNA, 97 nt, Salmonella typhimurium LT2
gggauggcgcgcgcauugaacaguuugaucgcaagggcaugguaaauaacaaauucaaccauuucauuaugaccaaacuggccgaggcgggcauccc

SEQ ID NO: 4247937 - RNA, 58 nt, Salmonella typhimurium LT2; identical to SEQ ID NO: 4246477

SEQ ID NO: 4247938 - RNA, 57 nt, Salmonella typhimurium LT2
gcuauuucuggugguucaguauugccggaaggaaaguuauuaaccgccaugaauagc

SEQ ID NO: 4247939 - RNA, 128 nt, Salmonella typhimurium LT2
gccuaucacgauaugggaugucagggggugcaggccguacuggaugccggguaugagauugccgcgauuuucacucaugccgacaauccugcggaaaacaccuuuuuuggcuccgucucccggcaggc

SEQ ID NO: 4247940 - RNA, 56 nt, Salmonella typhimurium LT2
caagguugagcguugggaagucgguugaugaaucgacauccacgcuauaauccuug

SEQ ID NO: 4247941 - RNA, 64 nt, Salmonella typhimurium LT2; identical to SEQ ID NO: 4246311

SEQ ID NO: 4247942 - RNA, 129 nt, Salmonella typhimurium LT2
gggguaaaagcagacauggaaugcuccuuaauucagacuggcggcgauuauaguaguuugauggcgcagauucgacagauuugcuauauuugcgccccugauuacaggagcguuucgcuaugacauccc

SEQ ID NO: 4247943 - RNA, 76 nt, Salmonella typhimurium LT2; identical to SEQ ID NO: 4246390

SEQ ID NO: 4247944 - RNA, 115 nt, Salmonella typhimurium LT2
cagccacugcccggaaaguacgccaaaaucgcucaguucuaucuuguugcccgccgucaacugcgggcagcccaucaagcugagcgugccggucugcugguauucguuguggcug

SEQ ID NO: 4247945 - RNA, 77 nt, Salmonella typhimurium LT2
cuggggagcggacucuggcgcguauauguuugguaaauuauuuggcaaacauaagcuggcgccgaagguuuccccgg

SEQ ID NO: 4247946 - RNA, 69 nt, Salmonella typhimurium LT2
ggcuccugauguuguugcaugaugguauaaauuuuaucaauaucaauauguugccgcaucgcuuccgcc

SEQ ID NO: 4247947 - RNA, 69 nt, Salmonella typhimurium LT2; identical to SEQ ID NO: 4246432

SEQ ID NO: 4247948 - RNA, 129 nt, Salmonella typhimurium LT2
gaacgccaguggucguuuuuaacgcuggagaugccgcaauggcuguuggggaucuuugccgcuuaccuugugguggcgauagccgucgucauagcccaggcauuuaagccuaaaaaacgcgaccuguuc

SEQ ID NO: 4247949 - RNA, 82 nt, Salmonella typhimurium LT2
ugaucggcaucgcuuaguccgguuggugauuugugauuuuuggcgauugaucaaaucacacaauccggacugaguucaauca

SEQ ID NO: 4247950 - RNA, 89 nt, Salmonella typhimurium LT2
ccuguuaucuugcugauuugcucugugguggcggcucuggcuucuguacugggcgaccucaccgagaguauguuuaagcgcgaagcagg

SEQ ID NO: 4247951 - RNA, 57 nt, Salmonella typhimurium LT2
gauugcauccggaagaguuaggucaggugcauauuucgcucaagcuggaugacaauc

SEQ ID NO: 4247952 - RNA, 116 nt, Salmonella typhimurium LT2
aguggaagucacucgcuaacgacguugugcccggauggcguguagcgauccgggccugaauuucagacuggauaagugaaacgccauccggcguugugcaguaacaggcuaccacu

SEQ ID NO: 4247953 - RNA, 67 nt, Salmonella typhimurium LT2
gacggagugcgcgauguuggcggcgaccuccaugcggaugccgucagcggugcgcgcuuccuggguc

SEQ ID NO: 4247954 - RNA, 80 nt, Salmonella typhimurium LT2
ccgucugauucgcgcguggcaaaaaccggaacuggucguuaucucggaauguuucuggacggccgccgcgaaacacgcgg

SEQ ID NO: 4247955 - RNA, 61 nt, Salmonella typhimurium LT2
uuacuuaauuuacuggucugguggcgagguuuucaccgacaggaagccguaaauuaagcgg

SEQ ID NO: 4247956 - RNA, 82 nt, Salmonella typhimurium LT2
ccggcagcaaauuaaaagucagacucagcagguuaccaucaaaaaucuuuauguaagcaguuucacuuuaguuugcuuucgg

SEQ ID NO: 4247957 - RNA, 82 nt, Salmonella typhimurium LT2
agcuggccguagauaucgguaaacgucaucgccauugggaaacggcggugguggaacuugcugauauuauuggcuccgggcu

SEQ ID NO: 4247958 - RNA, 76 nt, Salmonella typhimurium LT2; identical to SEQ ID NO: 4247324

SEQ ID NO: 4247959 - RNA, 70 nt, Salmonella typhimurium LT2
ccgaacguuuuauugaucugcucggcgacggagcgcgcaucaauguugccgacaacaaucagcgucaugg

SEQ ID NO: 4247960 - RNA, 61 nt, Salmonella typhimurium LT2; identical to SEQ ID NO: 4246559

SEQ ID NO: 4247961 - RNA, 70 nt, Salmonella typhimurium LT2
agacauguuggaaacuucggucgcguagucggaaucuucgauacggcuacgggcagaagucagguuguuu

SEQ ID NO: 4247962 - RNA, 89 nt, Salmonella typhimurium LT2
uguauuauugccauuaguuaaagaagccaauauugacccgauuuauuucggcgucauguucauuauuaacugcucuauuggauuaauca

SEQ ID NO: 4247963 - RNA, 75 nt, Salmonella typhimurium LT2
ggcgguggcggcggaacaucggcauuaauggugaaaaugaccguauaguugccgccguuuugccgcuucaccgcc

SEQ ID NO: 4247964 - RNA, 61 nt, Salmonella typhimurium LT2
uucgcuaucaugauauaucacugaagcccccauccccggcugauauaacgcaugacgcgaa

SEQ ID NO: 4247965 - RNA, 79 nt, Salmonella typhimurium LT2
gcugguguugauaagguuggugaccauauuucccagcaccaucagggaaagaucggucggcgccuuauguuuuuccagu

SEQ ID NO: 4247966 - RNA, 58 nt, Salmonella typhimurium LT2
gcggcgucacgggaauucaggugcgcgaaaccguccccgaucccuuuuuugaugccgc

SEQ ID NO: 4247967 - RNA, 60 nt, Salmonella typhimurium LT2
gauuuaccuucgacgaaguuaucaaauguauguuuuacauugacguuggagcgguagguc

SEQ ID NO: 4247968 - RNA, 97 nt, Salmonella typhimurium LT2
gugauuuaguccugauuagcgccgguauuuuuggcgguagcgcguugcugaugcagucgccguggcugcuggcgcuggucacauggggcggggucgc

SEQ ID NO: 4247969 - RNA, 113 nt, Salmonella typhimurium LT2
ugccgcagaaaauagcgccuggcaucaguggucgcuggacgccauccugcaacguuucgccgauuguugcaggucacucuccagcgcccugucggaguguguuguucgcggua

SEQ ID NO: 4247970 - RNA, 87 nt, Salmonella typhimurium LT2
uauuuuuacacauugacacacucccugucauauucacuacacgccauguugugguggguagaccgggagucugugaugaaaaagaua

SEQ ID NO: 4247971 - RNA, 60 nt, Salmonella typhimurium LT2
uccuacgcuugccauucuuaucaccgugaucaugugaagagugauaaaugacaaguggga

SEQ ID NO: 4247972 - RNA, 55 nt, Salmonella typhimurium LT2
gcacagaugcagguagucgaucucaucaacgugcuggucgauggcaaauuugugc

SEQ ID NO: 4247973 - RNA, 79 nt, Salmonella typhimurium LT2
uuaggguugcgcuagaaaguuuucuaccgauccuagaagucucuaggaucgguagaaaacuuucuagcgccuccucuag

SEQ ID NO: 4247974 - RNA, 71 nt, Salmonella typhimurium LT2
gcugguugggauaaugucgacgcgcuccagcaacguauuccacggaauacgacgcguguugccggaccagc

SEQ ID NO: 4247975 - RNA, 69 nt, Salmonella typhimurium LT2
guuguuuuucauugguggugggcugggcggguucaaaacgucgcagcgccacaccgccaugacuacggc

SEQ ID NO: 4247976 - RNA, 58 nt, Salmonella typhimurium LT2; identical to SEQ ID NO: 4245875

SEQ ID NO: 4247977 - RNA, 81 nt, Salmonella typhimurium LT2
ucaccaaaguugauccgcccgugaucggcacgcggguaaugccggaagaacuggugcacgagguggaacauaugauggaga

SEQ ID NO: 4247978 - RNA, 57 nt, Salmonella typhimurium LT2
agacaaggcuaucgcgcggaguuuauuaaacugguaaaacuggcggaaggcuugucu

SEQ ID NO: 4247979 - RNA, 65 nt, Salmonella typhimurium LT2
cggcaauacggccuuuaucgauaaaaaucagccgugaggcgacuuuuucggcaaagccgauuucg

SEQ ID NO: 4247980 - RNA, 81 nt, Salmonella typhimurium LT2
uuugcacagucugcagugcuaccaccguccccuaugcaccccagggcgaacgcuggcuaggcagcagacgacaacagcaga

SEQ ID NO: 4247981 - RNA, 130 nt, Salmonella typhimurium LT2
auagauauuaguaccgaugguuauguuaagcuuaauccugaauuucuuaccaggagugauauuaccuuuaguaacaaaccugcaggagauguguuaaguuuucagccuggagaugugguuuaugguuuau

SEQ ID NO: 4247982 - RNA, 90 nt, Salmonella typhimurium LT2
guugguguacuggauauuccaggcuucuauguuggcuugaccgaugaugucaaaguucagcuucagaagcuggaaaaacagaacguuaac

SEQ ID NO: 4247983 - RNA, 63 nt, Salmonella typhimurium LT2
ggcgaaaggccaucacuuuccggaugucacgcugguggcguugcuggaugucgauggcgcgcu

SEQ ID NO: 4247984 - RNA, 85 nt, Salmonella typhimurium LT2
uccgaccagcuuucguagucgccaauaccgagguagcggguaauuucgcccagcgcuucaguauggcggguacuuuccuggcgga

SEQ ID NO: 4247985 - RNA, 110 nt, Salmonella typhimurium LT2
auaccaaccgccaggauguuuucgaugccgcgcuggugcaacauuugauguuacuggcgggcacggugcugccggcgcuggcgaucggauuaccguugggcgucuggugu

SEQ ID NO: 4247986 - RNA, 125 nt, Salmonella typhimurium LT2
gcgguaauccggauuaacauacuuugcaaacuguugggcuuuuagcggcguccaggcgcgauucgcauccagacgcagaugcagauccgggaucgccuccagcagcaaauuaaccaccaugccgu

SEQ ID NO: 4247987 - RNA, 68 nt, Salmonella typhimurium LT2; identical to SEQ ID NO: 4247457

SEQ ID NO: 4247988 - RNA, 103 nt, Salmonella typhimurium LT2; identical to SEQ ID NO: 4246296

SEQ ID NO: 4247989 - RNA, 79 nt, Salmonella typhimurium LT2
agcuggcgcgcaaccaucggcuggcggagcgucuucuggagaccgaagagagcgugcggcgcgauguugcgcgugagcu

SEQ ID NO: 4247990 - RNA, 89 nt, Salmonella typhimurium LT2
gccgcuggccuggcgcuacggucuguacagcguaccgccgguaaccgacagcguggcgucgcuguacaaccgucugcuggaucaacugc

SEQ ID NO: 4247991 - RNA, 74 nt, Salmonella typhimurium LT2
cagccacucauuaagccgccagcguuaugcugacggcuuaacccguuaugcgcggcuggcggcuuucauggcug

SEQ ID NO: 4247992 - RNA, 67 nt, Salmonella typhimurium LT2
ugcuggaucauucugaacgcgauuugcguggccugcggccugcaaaaaggggucagaaucgccagcg

SEQ ID NO: 4247993 - RNA, 80 nt, Salmonella typhimurium LT2; identical to SEQ ID NO: 4246208

SEQ ID NO: 4247994 - RNA, 130 nt, Salmonella typhimurium LT2
ugauugccgccaucuuuacccugagccuugcgggauacaugcccgucugggagccgcugcucauuuaugcgcugggcacgcuaugguacggcguguuuaacugguuuugguucuggcuauggcgcgaaca

SEQ ID NO: 4247995 - RNA, 99 nt, Salmonella typhimurium LT2
gcggcgguuaucauuccugauuuuuccggaugauucagacaggguuccuauacuuaggcuguguaugauucauccggagaggaauaugaccaaagucgc

SEQ ID NO: 4247996 - RNA, 84 nt, Salmonella typhimurium LT2
cuuuaagaauagaugacgacgccagguuuuccaguuugcgacgaaggugauugaaaaaaccuggcguuuugucuguuaucagag

SEQ ID NO: 4247997 - RNA, 62 nt, Salmonella typhimurium LT2
ggcauuuuuggugguuucaccgggcauuauauuguagaaagccugcguacccgaaaaaugcc

SEQ ID NO: 4247998 - RNA, 61 nt, Salmonella typhimurium LT2
uggcuaucgccauuacgcauugccauguuagccagaacgcgaugcaaaugagcgagagccg

SEQ ID NO: 4247999 - RNA, 55 nt, Salmonella typhimurium LT2
ccgcugcuugcugcucuauccgggaucugacuuccggaucugcugaaggcagcgg

SEQ ID NO: 4248000 - RNA, 73 nt, Salmonella typhimurium LT2
cuggcggaaaucgcagguaucguuuccuucgguaaagaaaccaaaggcaaacgucgucuggugauuacgccgg

SEQ ID NO: 4248001 - RNA, 80 nt, Salmonella typhimurium LT2
agcauucuggcgaacgucgagcagauaaaaacgauugcggauuucaccgccaaugaccguuuuaugucggcgcugccgcu

SEQ ID NO: 4248002 - RNA, 80 nt, Salmonella typhimurium LT2
ccguugcccgccuguuggaaguaccaggcguguggcguuuuauccacauccguggugauuucaucaauccgcggcagcgg

SEQ ID NO: 4248003 - RNA, 83 nt, Salmonella typhimurium LT2
accggcgugucgguggccgguuuaauguugagcgccacuuucgggcuuaacagcggaauggucgcauaauucggcaccccggu

SEQ ID NO: 4248004 - RNA, 62 nt, Salmonella typhimurium LT2
uggcugacgaauauuauuaaaaguaaauucuuuuucuuuaugaauggcguauucgucaggca

SEQ ID NO: 4248005 - RNA, 99 nt, Salmonella typhimurium LT2
ucagcgcgcuggucacguuuagcggccugcuggucucgcuguuuuucgccgcccugguggauuacguggugcgcggcagccguuuuuaucagacgcuga

SEQ ID NO: 4248006 - RNA, 60 nt, Salmonella typhimurium LT2
gaauauugccuuucagcgccagacugguaccgaugccaguggcgauaagacgcaauguuc

SEQ ID NO: 4248007 - RNA, 57 nt, Salmonella typhimurium LT2
uccaacaguugcguaaucugauucaggccagcccgcuaucagacgauaagcugugga

SEQ ID NO: 4248008 - RNA, 67 nt, Salmonella typhimurium LT2
uugggcuaaaacucagugcgcauuaauucgucgcugauauugcuacgaaccugauuguuuuacccaa

SEQ ID NO: 4248009 - RNA, 83 nt, Salmonella typhimurium LT2
ugagguguuuccagugcagcuccugguccguaaccuggcguaguacgcgcgccggugaucccaccaggaguugccuugccuca

SEQ ID NO: 4248010 - RNA, 63 nt, Salmonella typhimurium LT2
gucugguuugaugguacgaacaagcugaacuauaucgccagcuaugugccuguuaagccggau

SEQ ID NO: 4248011 - RNA, 78 nt, Salmonella typhimurium LT2
gcaagucgauuagcgucggcgaucguaucgucggcguagggcaggccggaaaaccgauggucgacguuauuggcuggc

SEQ ID NO: 4248012 - RNA, 56 nt, Salmonella typhimurium LT2
ggcgugaguuccggcggcgcgguagcgggcgcguuacgcgucgcacgagccacgcc

SEQ ID NO: 4248013 - RNA, 80 nt, Salmonella typhimurium LT2; identical to SEQ ID NO: 4245868

SEQ ID NO: 4248014 - RNA, 62 nt, Salmonella typhimurium LT2
ucucuuugacuauuuucccugccugguucucauccguaucgguaauggucuggucaagggga

SEQ ID NO: 4248015 - RNA, 70 nt, Salmonella typhimurium LT2
ugacgaugcuuacgcugauagauaaagguggucagaaucaccgggaucacgaucgcgauaaccaucgcca

SEQ ID NO: 4248016 - RNA, 80 nt, Salmonella typhimurium LT2; identical to SEQ ID NO: 4245857

SEQ ID NO: 4248017 - RNA, 80 nt, Salmonella typhimurium LT2
gcgcguauugcagacggcgaaggcguuagguauucccguuaaaggccauguugagcagcuuucgcuguugggcggcgcgc

SEQ ID NO: 4248018 - RNA, 88 nt, Salmonella typhimurium LT2
cgcaggcauggacagcggacgauuuuggucgcggcgaaagcaaagucguugucgccgcgccagugauugccgagcugaauaugccgcg

SEQ ID NO: 4248019 - RNA, 61 nt, Salmonella typhimurium LT2
ggauacucaguugcggccauacgugccagcgcagcggcccgucaaguugcaacugauauuc

SEQ ID NO: 4248020 - RNA, 62 nt, Salmonella typhimurium LT2
cucgcuggcgaugcugcaucgcgcuuacuuugguaaggcgaagagccagauugccaguguag

SEQ ID NO: 4248021 - RNA, 72 nt, Salmonella typhimurium LT2
cgugcagcgguuaaagggaauguaguaaaccugucuuuagguuucucucacccgguugaccaucagcugccg

SEQ ID NO: 4248022 - RNA, 66 nt, Salmonella typhimurium LT2
cuguugcgcauccaguuccugacgggaaaccagauugguuuuugccaguugcugauagcgcgccag

SEQ ID NO: 4248023 - RNA, 73 nt, Salmonella typhimurium LT2
acguaacggugauuaucgacgcggucagcgggcgcaagcaggugcuggcgcacgcgucacuaaugccggacgu

SEQ ID NO: 4248024 - RNA, 104 nt, Salmonella typhimurium LT2
gcaucuuuuccgcugcgaugagcggcaucgauaucgcgcugugggauaucaaaggcaaagcguggggcgugccgcuguauaaaaugcuuggcggcaaaagucgc

SEQ ID NO: 4248025 - RNA, 61 nt, Salmonella typhimurium LT2
gccugauaagcgccgucuacaaaaaagccccucgugaagaggggcuuaauggcuaucgggc

SEQ ID NO: 4248026 - RNA, 59 nt, Salmonella typhimurium LT2; identical to SEQ ID NO: 4246171

SEQ ID NO: 4248027 - RNA, 130 nt, Salmonella typhimurium LT2
guauucuggcuuaacuauuuguucgcccgauggcggcugcgucuuaucgggccuaugugaacagaaauuguaggccggauaagcguagcgccauccggcagugaaauucgaagaauuuaaggaagucuau

SEQ ID NO: 4248028 - RNA, 83 nt, Salmonella typhimurium LT2
uagcagaccauuuucugcggcguuuugccgaacguaaccgcaaaguggugaagggguuuacgccgcaggcgauggaucugcug

SEQ ID NO: 4248029 - RNA, 60 nt, Salmonella typhimurium LT2; identical to SEQ ID NO: 4246381

SEQ ID NO: 4248030 - RNA, 89 nt, Salmonella typhimurium LT2
uggaaugacgcgccugcgcuaccgcugccggaaucagaccuggugaauaaagcgauggcgcuaagccaggcgguaaaucgucagcucca

SEQ ID NO: 4248031 - RNA, 78 nt, Salmonella typhimurium LT2
gccugaugcgcugcgcuuaucaggccuacagacgacaccgcacacguaggccggauaagacguuagucgccauccggc

SEQ ID NO: 4248032 - RNA, 90 nt, Salmonella typhimurium LT2; identical to SEQ ID NO: 4246267

SEQ ID NO: 4248033 - RNA, 91 nt, Salmonella typhimurium LT2
gccuucauuaagguauuaaucaguuggcuggccgccgggaaggugucaacgcgaauccggcuuuuggucugcugaucaaacauaauguggu

SEQ ID NO: 4248034 - RNA, 57 nt, Salmonella typhimurium LT2
cgacgcaaagaguacuggauguuuauucuggucaauaucaucuuuaccuuuguguug

SEQ ID NO: 4248035 - RNA, 89 nt, Salmonella typhimurium LT2
ggcgucgcgccggcaaguaaccccagauuugcgcuggugguggugauuaauaauccgcaaaauggggcuuauuauggcggugcgguauc

SEQ ID NO: 4248036 - RNA, 57 nt, Salmonella typhimurium LT2
cggaaagaccgaucagaucggcauucacuucacgcgccguucugaggauuuucuccg

SEQ ID NO: 4248037 - RNA, 68 nt, Salmonella typhimurium LT2
uaccuguuguggcguucggcaguacggaaauucccuguacauuuacgccaucgcgcgacaaucgggua

SEQ ID NO: 4248038 - RNA, 86 nt, Salmonella typhimurium LT2; identical to SEQ ID NO: 4246036

SEQ ID NO: 4248039 - RNA, 60 nt, Salmonella typhimurium LT2
guccgccaugauccaggcgugaucagcaauacugagcaccucuggcacaucaugcgagac

SEQ ID NO: 4248040 - RNA, 94 nt, Salmonella typhimurium LT2
gcgcuagcagugaacgaagagaaugccgcaggcggacgaguagucacugccccgacuaacggcgcaugugguauuguuccggcggugcuggcgu

SEQ ID NO: 4248041 - RNA, 57 nt, Salmonella typhimurium LT2
gcagagucgguacgucuugaacaagaggcgcucauugacgagguuuaccgcgccugc

SEQ ID NO: 4248042 - RNA, 61 nt, Salmonella typhimurium LT2
cauucgcauuugcccuuaaccccaguugacagccaucaggauuaacggcaaguacgacaug

SEQ ID NO: 4248043 - RNA, 91 nt, Salmonella typhimurium LT2
gccgcaguugcgcgugcauccggacgacuuacagcggguggaagagaugcugggcgccacgcucagucuucacggauggcgguuacgcggc

SEQ ID NO: 4248044 - RNA, 73 nt, Salmonella typhimurium LT2
gcuaucgcgaugucgcgcugcuaagccgggggcgugugguuguccaccgcaaaugcaucgugaccgccauggc

SEQ ID NO: 4248045 - RNA, 71 nt, Salmonella typhimurium LT2
agcgcagguugauagggcgaucgccgguuuugguaucuucugacggguaguaucgcucuauauccuguccu

SEQ ID NO: 4248046 - RNA, 56 nt, Salmonella typhimurium LT2
ucuuucgacuuuucgcccgaagagcucagcacuucuucaagcguaucggucaggga

SEQ ID NO: 4248047 - RNA, 99 nt, Salmonella typhimurium LT2
uccggcguuugcguaaagcuguugugucccgguccauacuggcgauucucauagcuggugguaaagaccgggcgcggugauuuaugccaguuggccgga

SEQ ID NO: 4248048 - RNA, 74 nt, Salmonella typhimurium LT2; identical to SEQ ID NO: 4246022

SEQ ID NO: 4248049 - RNA, 85 nt, Salmonella typhimurium LT2
ugagagcacguaggccugauaagcgcagcgccaucaggcaauccuggcgcacauugcugccuuauccggccuacaagccgccucg

SEQ ID NO: 4248050 - RNA, 65 nt, Salmonella typhimurium LT2
uauugacgauaucggcauugacgcgcuggacaaagucuuccagguucaggucgaugucaucaaug

SEQ ID NO: 4248051 - RNA, 64 nt, Salmonella typhimurium LT2
uugaacaagaguugcuugauaacgccuggcuuaccgcgcccgccgaucucaauauuuuguucaa

SEQ ID NO: 4248052 - RNA, 126 nt, Salmonella typhimurium LT2
gagaugacagcaguauagccagcgucuuucgccaucuugauugcagccagaguuucggucagagaaccgaucugguugaauuugaucaggauggaguuagcgaugccuuucucgaugccuucuuuc

SEQ ID NO: 4248053 - RNA, 56 nt, Salmonella typhimurium LT2; identical to SEQ ID NO: 4246258

SEQ ID NO: 4248054 - RNA, 89 nt, Salmonella typhimurium LT2
gccgcucacggcaaugucaccggcgaaauuggugguggugccguugccggaaaucagcgcgccgguggcguuguccaccguggaguggc

SEQ ID NO: 4248055 - RNA, 77 nt, Salmonella typhimurium LT2
gguggcuugcguucuguugcaccaauguggugcuuaauguucacauuaaagcacuauuuuggugcaacauagucacc

SEQ ID NO: 4248056 - RNA, 62 nt, Salmonella typhimurium LT2; identical to SEQ ID NO: 4245802

SEQ ID NO: 4248057 - RNA, 56 nt, Salmonella typhimurium LT2
ucgggaacagcaacgagcugauuuguaaguuaagccagcucuccaacuguuccaga

SEQ ID NO: 4248058 - RNA, 61 nt, Salmonella typhimurium LT2
gucagugccuuuggcggcagccagauaaaaaguggacuggcuguuaucaucaaggcguggc

SEQ ID NO: 4248059 - RNA, 60 nt, Salmonella typhimurium LT2
ugguuaaggcauuuucgccggccuccagagucuucaggcccggcggcaauguuucaggca

SEQ ID NO: 4248060 - RNA, 55 nt, Salmonella typhimurium LT2
uuuggugcuuuguugaauuuuugugauccucuucacaagaaauuuuaagcccggg

SEQ ID NO: 4248061 - RNA, 58 nt, Salmonella typhimurium LT2; identical to SEQ ID NO: 4246327

SEQ ID NO: 4248062 - RNA, 108 nt, Salmonella typhimurium LT2
gucugaaaccguauggcgucaggcaaacaaauacaaaguuccgcguauugcguucguuaacaaaauggaccgcaugggcgcgaacuuccugaaaguuguuggucagau

SEQ ID NO: 4248063 - RNA, 70 nt, Salmonella typhimurium LT2
acggugugcgcccugcgccaguuguuccagaaugguuuucaggaacgggcuuuucaggguguaguagcgu

SEQ ID NO: 4248064 - RNA, 77 nt, Salmonella typhimurium LT2
ggcgcuguacuggcgaauacguugagcaaucugauuuccgcaguauugcuuaucuacuuauuccgccuguauauguu

SEQ ID NO: 4248065 - RNA, 65 nt, Salmonella typhimurium LT2
cguugucacguggcgauucgaaaaaucgggcagguauggugauaacggauggcgacguggcagcg

SEQ ID NO: 4248066 - RNA, 91 nt, Salmonella typhimurium LT2; identical to SEQ ID NO: 4246748

SEQ ID NO: 4248067 - RNA, 59 nt, Salmonella typhimurium LT2; identical to SEQ ID NO: 4246151

SEQ ID NO: 4248068 - RNA, 75 nt, Salmonella typhimurium LT2
uggguugacuuagcgcgauguagcgcgguuuuucguggaaauuagcugcaaacggugcgauaucggcuucaucca

SEQ ID NO: 4248069 - RNA, 61 nt, Salmonella typhimurium LT2
gcauguuugccugagcgcgaacuacaugucuccucagauguaucgcgcuuacacagacugc

SEQ ID NO: 4248070 - RNA, 74 nt, Salmonella typhimurium LT2
uugguuaucccacucucgccaaucauccacucuuuauccaggacugaaaauacagcgaugagugggauagccag

SEQ ID NO: 4248071 - RNA, 57 nt, Salmonella typhimurium LT2; identical to SEQ ID NO: 4247350

SEQ ID NO: 4248072 - RNA, 66 nt, Salmonella typhimurium LT2
uauuguucauguugucauuauaaaagugacgaauuuucgucguugugaugaauagcaaacucaaug

SEQ ID NO: 4248073 - RNA, 84 nt, Salmonella typhimurium LT2; identical to SEQ ID NO: 4246712

SEQ ID NO: 4248074 - RNA, 67 nt, Salmonella typhimurium LT2
cgguacuaaggagaguaaugagacauaggcgagguuucccgccagagucgucauauuauccucaucg

SEQ ID NO: 4248075 - RNA, 71 nt, Salmonella typhimurium LT2
cagcaugugguucaacauguucgaccuggcgcaugcauacgcgcagggcgagggcaugaagcacuauguug

SEQ ID NO: 4248076 - RNA, 86 nt, Salmonella typhimurium LT2
acgcuuugggcgauucccggcgcgcugaccacgcaguuugccgcccugacgggagccuguaucgucggcgcgcugguguucggcgu

SEQ ID NO: 4248077 - RNA, 87 nt, Salmonella typhimurium LT2
aucaacccggcgccgcgcgguaugccgcagaucgaagucaccuucgauaucgaugcugacgguauccugcacgucuccgcgaaagau

SEQ ID NO: 4248078 - RNA, 69 nt, Salmonella typhimurium LT2; identical to SEQ ID NO: 4246136

SEQ ID NO: 4248079 - RNA, 77 nt, Salmonella typhimurium LT2
cugccgacauccgcuuuuccacggcccgccaguucaagcgcggugccguggucaacggagguucgaauaaaagguag

SEQ ID NO: 4248080 - RNA, 73 nt, Salmonella typhimurium LT2; identical to SEQ ID NO: 4246345

SEQ ID NO: 4248081 - RNA, 86 nt, Salmonella typhimurium LT2; identical to SEQ ID NO: 4246142

SEQ ID NO: 4248082 - RNA, 64 nt, Salmonella typhimurium LT2
ucauccacguugaugugaacuauucugaccuguacaccggucugauugacgucaaucugggcga

SEQ ID NO: 4248083 - RNA, 55 nt, Salmonella typhimurium LT2
auccgcagaugaagcgggcgcuggauaacuucaaggccgugcuggaucugcggau

SEQ ID NO: 4248084 - RNA, 87 nt, Salmonella typhimurium LT2
augccaaucauggaaggauuggccaguguuucaaaguccugagcccacagggcauucagcaauugagucaguaguuccauucaguau

SEQ ID NO: 4248085 - RNA, 78 nt, Salmonella typhimurium LT2
gcgcaggcgcgccgcgguaccugauaggggccggguaauacccccucaguaugcaggccgcgauaaaccgccugcugc

SEQ ID NO: 4248086 - RNA, 55 nt, Salmonella typhimurium LT2
aguaauaccaguucaucggcgucaggguaauuucuggcggcguacucgguauucu

SEQ ID NO: 4248087 - RNA, 69 nt, Salmonella typhimurium LT2
uugaucgaugaugaacaucaccgacggcacuuccagcauaaugccgagugggaucuucucaucgaacgg

SEQ ID NO: 4248088 - RNA, 75 nt, Salmonella typhimurium LT2
cuauaauccaguacuuauccgggugaauaccgacucaggauuaagugguauuggcgaaguaggacuggccuaugg

SEQ ID NO: 4248089 - RNA, 92 nt, Salmonella typhimurium LT2; identical to SEQ ID NO: 4247438

SEQ ID NO: 4248090 - RNA, 100 nt, Salmonella typhimurium LT2
ggcacgcucacuauucugacaauauucagcguaaagaagauuaacagcaauaaguccuguuauuuccugcguggauauuucuuuaguuaauuuucgugcc

SEQ ID NO: 4248091 - RNA, 60 nt, Salmonella typhimurium LT2; identical to SEQ ID NO: 4246358

SEQ ID NO: 4248092 - RNA, 66 nt, Salmonella typhimurium LT2
gcaacugaauuucuccggcgcgcagauggcugcgcucucuaucuguaucgccggcgguucaauugu

SEQ ID NO: 4248093 - RNA, 67 nt, Salmonella typhimurium LT2; identical to SEQ ID NO: 4245869

SEQ ID NO: 4248094 - RNA, 55 nt, Salmonella typhimurium LT2
uuucagguggccuucacgcuguaauaccggaacgcuggcguagggcacaaugaaa

SEQ ID NO: 4248095 - RNA, 59 nt, Salmonella typhimurium LT2
ucauucgccaucagccggcaauaaagaucgcgguuaauuuugcugacugguaggcguga

SEQ ID NO: 4248096 - RNA, 59 nt, Salmonella typhimurium LT2
gcggugcgacaaacguucgggcgaucgccguugaucgccaggggaaaauugucgcccgc

SEQ ID NO: 4248097 - RNA, 66 nt, Salmonella typhimurium LT2
guugggcuuaaugccguagagucuauugcggacgccacccccagacucugcggguugauguuuggc

SEQ ID NO: 4248098 - RNA, 66 nt, Salmonella typhimurium LT2
acagaauggcauccgccugcucgcacccuucaacgguggcuuucggcaguggaugaccaugauugu

SEQ ID NO: 4248099 - RNA, 67 nt, Salmonella typhimurium LT2; identical to SEQ ID NO: 4245872

SEQ ID NO: 4248100 - RNA, 55 nt, Salmonella typhimurium LT2
cccggaaaccaucauggaugcgcuguuugaacaggggaucaugguggauuccggg

SEQ ID NO: 4248101 - RNA, 58 nt, Salmonella typhimurium LT2
gcggacgucugaaaucgugaccugguuuaucaccacaucaauacguuuagcguccagc

SEQ ID NO: 4248102 - RNA, 66 nt, Salmonella typhimurium LT2
uugcgcggucagaauuuccagcauuugcugaauauuguagccuucggcugguuuuugaccgcguaa

SEQ ID NO: 4248103 - RNA, 72 nt, Salmonella typhimurium LT2
aucauguuuacucuacuggccguaggcgcgcuguucggcgcguuauuuauauggcuauuaggguagacgggu

SEQ ID NO: 4248104 - RNA, 100 nt, Salmonella typhimurium LT2
gauguuuuugguauagauaagguacuugccguugacgacguaagccggaacacccugaauuuuggcaacgucauaggcggcuuuccauuuuuccagcguc

SEQ ID NO: 4248105 - RNA, 72 nt, Salmonella typhimurium LT2; identical to SEQ ID NO: 4246356

SEQ ID NO: 4248106 - RNA, 80 nt, Salmonella typhimurium LT2; identical to SEQ ID NO: 4246344

SEQ ID NO: 4248107 - RNA, 59 nt, Salmonella typhimurium LT2
ugaaaaaucguuauggcgcuuugaugcaaaccaucuccggcguacauuacaauuuuuca

SEQ ID NO: 4248108 - RNA, 60 nt, Salmonella typhimurium LT2; identical to SEQ ID NO: 4246496

SEQ ID NO: 4248109 - RNA, 70 nt, Salmonella typhimurium LT2
cuuuuucuucacauugucagacacaugaagcacuucuucaaacugauaacaaugugggcaguagaaggag

SEQ ID NO: 4248110 - RNA, 94 nt, Salmonella typhimurium LT2
ggugauauugcuguugcuggccucgccuguacuugaugucuggcguauuagcgucaacagccauauggcgcguuaccauagugguaaaauuacu

SEQ ID NO: 4248111 - RNA, 72 nt, Salmonella typhimurium LT2
ggcguauggcuggagauaggcgcgcuuucgugcguugaagagcgcgcgguucguuucaguuuugauaucgcc

SEQ ID NO: 4248112 - RNA, 78 nt, Salmonella typhimurium LT2
gcccggcggcgcuacgcuuaucaggccuacggggauauaucuguaggccggauaaggcguaacacgucgccauccggc

SEQ ID NO: 4248113 - RNA, 70 nt, Salmonella typhimurium LT2
uccggcaacauugugaugccugaugacgacgcgauugcgucuuaucaggccuacggucuuugcaaacgga

SEQ ID NO: 4248114 - RNA, 65 nt, Salmonella typhimurium LT2
guggcugagguguuugccuaugcgccguaauuacauguuggcgccauaaucucauacuuugccgc

SEQ ID NO: 4248115 - RNA, 74 nt, Salmonella typhimurium LT2
gcaauguggucacggaugaauuugugcacugccugcgccugcgcaggaguugcagauuuaccgguaccgaucgc

SEQ ID NO: 4248116 - RNA, 69 nt, Salmonella typhimurium LT2
guucuauggcgaugucgaauuuaauauggaugcggcaagccguuccgguagucugacaucgacgagaac

SEQ ID NO: 4248117 - RNA, 61 nt, Salmonella typhimurium LT2
guuuuugagaucguuugcugaaaccggccguucgaaguguccguagugcgauuuuaaaaac

SEQ ID NO: 4248118 - RNA, 66 nt, Salmonella typhimurium LT2
ccgggcggguauuugagcacggugugacggacuguuacacccuguuccgugaugcguaccaucugg

SEQ ID NO: 4248119 - RNA, 62 nt, Salmonella typhimurium LT2
cgugcuggcagaagaaauggcagacgcggcgcaaagcgcucugcuggccgcugccgguuuug

SEQ ID NO: 4248120 - RNA, 75 nt, Salmonella typhimurium LT2
uguuucgacaguagcuuauaugugaccggguuagcagcacauuccccuccgccacauuccaguacaguugaaaua

SEQ ID NO: 4248121 - RNA, 76 nt, Salmonella typhimurium LT2
ugcccgguggcgcugcgcuuaccgggccuacagguacagaugcuguaggccggauaagcguuagcgccaccgggca

SEQ ID NO: 4248122 - RNA, 106 nt, Salmonella typhimurium LT2
agauucugcgugccgguaacgaucacgaaaaagaguaucuggugacgguggauaaaccgauuaccgacgaguuuauucgugguaugggcgcuggcgugccgauucu

SEQ ID NO: 4248123 - RNA, 95 nt, Salmonella typhimurium LT2
gcugacaaugugccggauggcgcuaaugcuuauccggccuacagguugucgcaacguguaggccugguaagcgcagcgccaccgggcaacccggc

SEQ ID NO: 4248124 - RNA, 62 nt, Salmonella typhimurium LT2
auaaaucacgguaagaggagucagguaaacguuugccuggcaaucuauuuauggugaauuau

SEQ ID NO: 4248125 - RNA, 70 nt, Salmonella typhimurium LT2
gaaaauuuuccgccguaguuaucuggauaaaacccaccaguuuuaugaaaaacacggcgguaaaacuauc

SEQ ID NO: 4248126 - RNA, 62 nt, Salmonella typhimurium LT2
gccgcguuguauuuaucuucgugaucuuuauccagauucaguagcagauagaugcgcagggc

SEQ ID NO: 4248127 - RNA, 57 nt, Salmonella typhimurium LT2; identical to SEQ ID NO: 4245806

SEQ ID NO: 4248128 - RNA, 56 nt, Salmonella typhimurium LT2
uugacuuugggucugcgcgucgcguccguccgggcaguaccaguaaccaaagucaa

SEQ ID NO: 4248129 - RNA, 57 nt, Salmonella typhimurium LT2
ugaaugcggcggauggugcgugauuugccgcggaucagcagcguuuccgucguggca

SEQ ID NO: 4248130 - RNA, 62 nt, Salmonella typhimurium LT2
ccugaaaaugaugcaggcagaucaaccauaccgaaagguggacugucugccugauuaucagg

SEQ ID NO: 4248131 - RNA, 57 nt, Salmonella typhimurium LT2
gcgguugaucggguaguuugcggagcgcaucaucggcaccagcagcgcggcgaccgc

SEQ ID NO: 4248132 - RNA, 61 nt, Salmonella typhimurium LT2
gccggguagcgugaaauaauuagcgcuaacaauuuagcaggaguuaaucauguuugcaggu

SEQ ID NO: 4248133 - RNA, 95 nt, Salmonella typhimurium LT2
gcgccgggacagccugaccugugcacugccgaguuugauggcgggcagguugccgcgguuaacccggauacgggcauaguguuuucccguugcgc

SEQ ID NO: 4248134 - RNA, 118 nt, Salmonella typhimurium LT2
gucuggagcaguacuuuggcgauagcguggaucuguuugacuccggaacgggguaucacaauccugucgcguuaaaacugggucucaacuauacgccaguaccuuugcuuaccaugac

SEQ ID NO: 4248135 - RNA, 55 nt, Salmonella typhimurium LT2
gacuuggagaugaaacauguuucuagcaauagauaaugagauaucauccauaguc

SEQ ID NO: 4248136 - RNA, 128 nt, Salmonella typhimurium LT2; identical to SEQ ID NO: 4246067

SEQ ID NO: 4248137 - RNA, 76 nt, Salmonella typhimurium LT2
gaguauuuauugugcauagagguaagaaugugacaacggcccguugcauucucgucugucaugcacaucaacacuu

SEQ ID NO: 4248138 - RNA, 66 nt, Salmonella typhimurium LT2; identical to SEQ ID NO: 4246595

SEQ ID NO: 4248139 - RNA, 64 nt, Salmonella typhimurium LT2
gcuaucgccugagcuguaacggcagagugagcgauuaccugaaguuacagauucaggggaaugc

SEQ ID NO: 4248140 - RNA, 68 nt, Salmonella typhimurium LT2
cgagcugcaccgguuuccaguccagcguaccguucgcgguguggaacggcagaucggaaagcggcuug

SEQ ID NO: 4248141 - RNA, 100 nt, Salmonella typhimurium LT2
uacuucacucgcgggcgguaacgucgcggccgcggugugcucagcgucugcguccagccugcugggcauuuuccugucgccgcugcuggucggucuggua

SEQ ID NO: 4248142 - RNA, 59 nt, Salmonella typhimurium LT2
ggcguuuuucgaccgcuuccaugccuauauccccggcugggaaauuccgaaaaugcgcc

SEQ ID NO: 4248143 - RNA, 94 nt, Salmonella typhimurium LT2
agccguugcacugcccgguggcgcuaacgcuuaccgggccuacagauuuuuccauuguaggcagcauaagcguuagcgccaucggcacaacgcu

SEQ ID NO: 4248144 - RNA, 64 nt, Salmonella typhimurium LT2; identical to SEQ ID NO: 4246287

SEQ ID NO: 4248145 - RNA, 56 nt, Salmonella typhimurium LT2
gcaucagcaaaaugggaucggcgugacggaagcgaugacccacaucgugcagaugc

SEQ ID NO: 4248146 - RNA, 65 nt, Salmonella typhimurium LT2
ccgauggugaucagcgcuaccagaaauuuggcgaagaucuggaaaccguugaucauuuuuuccgg

SEQ ID NO: 4248147 - RNA, 72 nt, Salmonella typhimurium LT2
cgggcuuauuuuugauggugaaaauacagguauugguaucaagcaugaauuucagcaucaaaauccuucccg

SEQ ID NO: 4248148 - RNA, 67 nt, Salmonella typhimurium LT2
gagauacucuugauaacgguaggcuucagcacucgguuguugagcaauagccguaucaaacauuuuc

SEQ ID NO: 4248149 - RNA, 79 nt, Salmonella typhimurium LT2
cgcuuaauugaugccgcgucgcuuagugauuaucgucgccagacggggcuggucacucaggaugucgcauuauuuagcg

SEQ ID NO: 4248150 - RNA, 112 nt, Salmonella typhimurium LT2
guuguauaauuugccggauggcgaugcaaugcgucuuauccggccuacggauugauacggauugauguuguaggccugauaagcgaagcgccaucaggcaguguuaugcgau

SEQ ID NO: 4248151 - RNA, 127 nt, Salmonella typhimurium LT2
acccgcaggacgguuccguuauuuuugaugaucagauccguggcccgaucgaauucagcaaucaggagcuggacgaucugaucauucgucguaccgacgguuccccaaccuacaacuucuguguggu

SEQ ID NO: 4248152 - RNA, 56 nt, Salmonella typhimurium LT2
augccggagauagaggcuuucagcguaaucgcggaaaucaucuuccacuucggcgu

SEQ ID NO: 4248153 - RNA, 60 nt, Salmonella typhimurium LT2; identical to SEQ ID NO: 4246047

SEQ ID NO: 4248154 - RNA, 56 nt, Salmonella typhimurium LT2
guggucgccagccagcgugucggugccaaucagcgccagcgcgcuuuuggcgcugc

SEQ ID NO: 4248155 - RNA, 67 nt, Salmonella typhimurium LT2
gcuccggcugggugaggcggcuacgcuuagcgcuaucgccagccagacgcuguuaccuaagccgggc

SEQ ID NO: 4248156 - RNA, 84 nt, Salmonella typhimurium LT2
gcggucgacauuaacuaugguaaaggagaggcuuauguuucguuggggcauuauauuucugguuaucgcguuaauugccgccgc

SEQ ID NO: 4248157 - RNA, 81 nt, Salmonella typhimurium LT2
gucgcgugaugcggcgguaaagauaucggcagugucuucaucuuuggcuucaccaauagcuuugcgaacaucauuagcgac

SEQ ID NO: 4248158 - RNA, 80 nt, Salmonella typhimurium LT2
cuuuuuacguagcucgugcgcauuagucagguugccauuaugggccaacgugaugccauacggcgaguuaacguaaaaag

SEQ ID NO: 4248159 - RNA, 103 nt, Salmonella typhimurium LT2
acgggcgguacugaagcuauccgacaugugcugcaaccgcugccgcuuuccaguccggcagugauuauuacgcagcauaugccgccuggcuuuacccgcucgu

SEQ ID NO: 4248160 - RNA, 55 nt, Salmonella typhimurium LT2
cggcggcguuauugcgcccggcuaccaugaagagcuggacgaauggcgcgcgcug

SEQ ID NO: 4248161 - RNA, 83 nt, Salmonella typhimurium LT2
guucuccggcgguuacucgucgcggcuucaaagaagcggaagugaaagagcuggcuggcuggaugugugacgugcuggacaac

SEQ ID NO: 4248162 - RNA, 77 nt, Salmonella typhimurium LT2
gcggugauauuccagagaaucuaucgggucgucggugguuccgaccauccgcacauucaucugcugcauaauaccgc

SEQ ID NO: 4248163 - RNA, 81 nt, Salmonella typhimurium LT2
uuuauccccgaaccuucagguuuccccagacggcgacguaacgguguuuccucuggcggcuugaaguaugacggggauaaa

SEQ ID NO: 4248164 - RNA, 62 nt, Salmonella typhimurium LT2
ugggggccugauccgcaaagccgggaaugaugcguuccaggcuaugugcauacaagcgccca

SEQ ID NO: 4248165 - RNA, 113 nt, Salmonella typhimurium LT2
guaaaagcuaaugccggauggcggcgugaacgccuuguccggccuacaggugagauaccguuguaggccggauaagacgcguuagcaucgccauccggcauucugcuauuuac

SEQ ID NO: 4248166 - RNA, 82 nt, Salmonella typhimurium LT2; identical to SEQ ID NO: 4247002

SEQ ID NO: 4248167 - RNA, 60 nt, Salmonella typhimurium LT2; identical to SEQ ID NO: 4245769

SEQ ID NO: 4248168 - RNA, 67 nt, Salmonella typhimurium LT2
cauaccgcaacgggagucagcgggauaacggcggccacaccgaugcugacgccccugaugcuggaug

SEQ ID NO: 4248169 - RNA, 55 nt, Salmonella typhimurium LT2
gugacuuugcgcugaaaaaagagaaugagcuuuacuucauucagggcaagguggc

SEQ ID NO: 4248170 - RNA, 106 nt, Salmonella typhimurium LT2
uccauagugguaagccgcuuucuuuuguuuaugacauugccgauaucaucaaauuugaaucgguggugcccaaagcauuugagaucgcugcucgucacccggcgga

SEQ ID NO: 4248171 - RNA, 67 nt, Salmonella typhimurium LT2; identical to SEQ ID NO: 4246915

SEQ ID NO: 4248172 - RNA, 56 nt, Salmonella typhimurium LT2
ugccauuuagcugagaaaagauuucaaccuuauauuucuuccagcaaaugauggcg

SEQ ID NO: 4248173 - RNA, 71 nt, Salmonella typhimurium LT2; identical to SEQ ID NO: 4245952

SEQ ID NO: 4248174 - RNA, 93 nt, Salmonella typhimurium LT2
gcucucacucuguuugccgaacgcauucgcgccaccauuggcagcuauauuaugcaaaugggaggacuggaugcgcugguauucacugggggc

SEQ ID NO: 4248175 - RNA, 59 nt, Salmonella typhimurium LT2
gcguauugaauuucacaagcauggugguccggaagugcuucagaccguggaguuuacgc

SEQ ID NO: 4248176 - RNA, 56 nt, Salmonella typhimurium LT2; identical to SEQ ID NO: 4246544

SEQ ID NO: 4248177 - RNA, 89 nt, Salmonella typhimurium LT2; identical to SEQ ID NO: 4246150

SEQ ID NO: 4248178 - RNA, 59 nt, Salmonella typhimurium LT2; identical to SEQ ID NO: 4246094

SEQ ID NO: 4248179 - RNA, 69 nt, Salmonella typhimurium LT2
uucgguauggcaugaugcggaaucggcauuguauucauagacuuucagcccgcguucauccaugcagaa

SEQ ID NO: 4248180 - RNA, 69 nt, Salmonella typhimurium LT2
uuggcguccaugaaguccaugccaucuggccagguagccggaugcgcaccauggcuucugcggcggcgg

SEQ ID NO: 4248181 - RNA, 62 nt, Salmonella typhimurium LT2
gugccaauggagagcgaugccgguagccagauucgccacuggcauaccuaucuccaugacau

SEQ ID NO: 4248182 - RNA, 94 nt, Salmonella typhimurium LT2
gacagccuuuauagcagaaguggcguuagccuccagcccgacgcauaaauccgaucuggcgguggcuggcgccgugguugucgccugggccguc

SEQ ID NO: 4248183 - RNA, 72 nt, Salmonella typhimurium LT2
guguucacucuugagauuugguauucauuuuucguccgaggacguuaagaauccguaucuucgagugcccac

SEQ ID NO: 4248184 - RNA, 72 nt, Salmonella typhimurium LT2
gauguuguuguaagaaagcgcuuugcccugaaccugcugugcgguggcaacggacgcuucuuucacauuuuc

SEQ ID NO: 4248185 - RNA, 55 nt, Salmonella typhimurium LT2
uuaccgaugagguggucgcgcacucuccggaagugcugacccguucuuacgguga

SEQ ID NO: 4248186 - RNA, 68 nt, Salmonella typhimurium LT2
gcaggcuacgguacugcccaccuucgcggauaaacaccggaauucuguucaguggcguagcguacugc

SEQ ID NO: 4248187 - RNA, 93 nt, Salmonella typhimurium LT2
ggcgcguucuuuaucgauaucgucaaugcguuggugaucaagcuguaccugaugcugccaauguuugccggauaaagaugaaaaaacguugcc

SEQ ID NO: 4248188 - RNA, 58 nt, Salmonella typhimurium LT2
gcgccaucgcucugggaaucguacgaugcgcuuuuuuaauuuccggcgccauuggcgu

SEQ ID NO: 4248189 - RNA, 57 nt, Salmonella typhimurium LT2; identical to SEQ ID NO: 4246672

SEQ ID NO: 4248190 - RNA, 79 nt, Salmonella typhimurium LT2
uacucucauaauucgcuccguuaagccuaugguauggaauaaccauagcauaacaaagaugcgaaaagugugacaugua

SEQ ID NO: 4248191 - RNA, 71 nt, Salmonella typhimurium LT2
gcaauggcgacaggaaucugugugaggcagaaaauccccauaaacuucacaacagacccugucgcuccggc

SEQ ID NO: 4248192 - RNA, 74 nt, Salmonella typhimurium LT2
aguguugaugugcaugacagacgagaaugcaacgggccguugucacauucuuaccucuaugcacaauaaauacu

SEQ ID NO: 4248193 - RNA, 106 nt, Salmonella typhimurium LT2
ccguggccggaauuuucacaaucgcuuuuuuaaccggcgcagguuuaccacgcguacaaagcggacgguggaccugguugggauaaaaaagcgcgaaaucgccagg

SEQ ID NO: 4248194 - RNA, 105 nt, Salmonella typhimurium LT2; identical to SEQ ID NO: 4246069

SEQ ID NO: 4248195 - RNA, 69 nt, Salmonella typhimurium LT2
uuuaaaaccgcaaaagaaaagcauccguaguucugcgaaaaacggaucguuuuauuuugccguucugaa

SEQ ID NO: 4248196 - RNA, 55 nt, Salmonella typhimurium LT2; identical to SEQ ID NO: 4247224

SEQ ID NO: 4248197 - RNA, 62 nt, Salmonella typhimurium LT2
cgcuugcgauaacgcgauucucgcacaugaacgcuugucgauuguugauguuaacgcuggcg

SEQ ID NO: 4248198 - RNA, 80 nt, Salmonella typhimurium LT2
ugccgcggugcauuuugccggucauccaagccgcaaccuguuuguugccggcgagaugauggcaggaaauguucugggca

SEQ ID NO: 4248199 - RNA, 82 nt, Salmonella typhimurium LT2
guuuaucgucuggcuggagucucagggcgcauucaaucacccuuacuggaugugucguggcucuuggucuuacgcuuauaac

SEQ ID NO: 4248200 - RNA, 57 nt, Salmonella typhimurium LT2
auuggcaccgacacgcuggcuggcgaccacugucagcuggugauuuccggugccgau

SEQ ID NO: 4248201 - RNA, 88 nt, Salmonella typhimurium LT2
uaauguuaacgucgucauucauggcgcgcgccgccucgaucuccucgacuaaaggcagcgcgcugucuuugaauaacgcgacccauug

SEQ ID NO: 4248202 - RNA, 55 nt, Salmonella typhimurium LT2
cagcgccggucuggggcugugucaugcgauggcgcaccagccuggggcggcgcug

SEQ ID NO: 4248203 - RNA, 83 nt, Salmonella typhimurium LT2
gugcggugaacgaucggcuggugauucaggaagugcuggaggccagcgauauccccuaucgccacgaucgucaguuauuacau

SEQ ID NO: 4248204 - RNA, 66 nt, Salmonella typhimurium LT2
ggcacacugauuggcgcuggugucggcaaacugcuuccggccccagaaaccaucggucuggaugcc

SEQ ID NO: 4248205 - RNA, 66 nt, Salmonella typhimurium LT2
ucagcgccgcgucguccgccggaagcagaccgacaaucucuuucgcauguucgaccguggcggcga

SEQ ID NO: 4248206 - RNA, 70 nt, Salmonella typhimurium LT2
gauggcgcuacgcuuaucaggccuacagguugcagaaacguguaggccggauuaggcguuagccgccauc

SEQ ID NO: 4248207 - RNA, 68 nt, Salmonella typhimurium LT2; identical to SEQ ID NO: 4246195

SEQ ID NO: 4248208 - RNA, 69 nt, Salmonella typhimurium LT2
uugucagggugauacuggcguugcagauccugaaaacgaaggcucagcgccugggugucaaucugauaa

SEQ ID NO: 4248209 - RNA, 62 nt, Salmonella typhimurium LT2
ucgcucauuguaguaaucucaaacuuauauuggggugguuuguugagcuaauaauagagcga

SEQ ID NO: 4248210 - RNA, 64 nt, Salmonella typhimurium LT2; identical to SEQ ID NO: 4245817

SEQ ID NO: 4248211 - RNA, 69 nt, Salmonella typhimurium LT2
guauaaggaugcaguggauuaugguacaccucaucauaggugcccaauucuacugcaugaccgagauac

SEQ ID NO: 4248212 - RNA, 77 nt, Salmonella typhimurium LT2
gcacaggcuggaauugauaugaaugacaugugguugaccaguagccacggucguugcgucagcuucgagcaguuagc

SEQ ID NO: 4248213 - RNA, 67 nt, Salmonella typhimurium LT2
uggcggcuggggcuuauccggccugcaaaucaucaccaaucuguaggcccgguaagcgucagcgcca

SEQ ID NO: 4248214 - RNA, 81 nt, Salmonella typhimurium LT2
uguuggccguauuacugacaagccauguugcccaugccagcauuguuguuggcggaacccgacugguuuucgacggcaaua

SEQ ID NO: 4248215 - RNA, 71 nt, Salmonella typhimurium LT2
ggccgaggaucacuuugucgucgcccaccugcucgcgaaugcgcgccacggcgucgucgaugaucuucgcc

SEQ ID NO: 4248216 - RNA, 60 nt, Salmonella typhimurium LT2
cggcgagcauugaaucagugcuguucaacgguggcaagcuacugacgcaaauguuugucg

SEQ ID NO: 4248217 - RNA, 78 nt, Salmonella typhimurium LT2
gccaugcagcguuaacuggaaggcgguacggguacgcagcguaauuucgccgccuuccggccccagcgccugcaaggc

SEQ ID NO: 4248218 - RNA, 67 nt, Salmonella typhimurium LT2; identical to SEQ ID NO: 4246110

SEQ ID NO: 4248219 - RNA, 96 nt, Salmonella typhimurium LT2
acaugcuaccgacgagcagaucgcguuguuaacgaaagcgcuggaaauuaauagccagucgcuggaugacaacgcgcuguuuauucguucagaugu

SEQ ID NO: 4248220 - RNA, 69 nt, Salmonella typhimurium LT2
cggcauuuuacguaccguucccaaccguuuccucuccggacugggcacguuguacguagaacuguuccg

SEQ ID NO: 4248221 - RNA, 85 nt, Salmonella typhimurium LT2
cgucaguuacuggaguucaaaccguuauuaauuaaaccaaaugaugaagagguuaaagcaauauucgguuuaacugucucugacg

SEQ ID NO: 4248222 - RNA, 77 nt, Salmonella typhimurium LT2
gugacgcguuuugguaaauucagccaucugguagagccaggucugaacuggaagccgacauuuauugacgacgucac

SEQ ID NO: 4248223 - RNA, 76 nt, Salmonella typhimurium LT2
ggugacggcgugccugauggcgcugugcuuaucaguccugucagauaagacgcgucgccaucuggcucguuacauc

SEQ ID NO: 4248224 - RNA, 76 nt, Salmonella typhimurium LT2
uucuccgacaucccucgggcguaguuugcgccgccgcccgcuggcgcguaaaaaacugucugaaaugguugaggaa

SEQ ID NO: 4248225 - RNA, 114 nt, Salmonella typhimurium LT2
aaccagaccguaugccagccgcuacugugcgcggaggguuuaccgugguguggauugucaucaucgccuucaucuucauguucauagauaaauaagcucuggugcguuuugguu

SEQ ID NO: 4248226 - RNA, 81 nt, Salmonella typhimurium LT2
cucucaguugaccgacgaagcagauuuuagcccacgcaaggcgcugcauaauccagauuugcuugaguuguuuagcuggag

SEQ ID NO: 4248227 - RNA, 58 nt, Salmonella typhimurium LT2
cgcccagaaaggcgagaucaugccgaauauuccgcagauguccgccuucugguaugcg

SEQ ID NO: 4248228 - RNA, 80 nt, Salmonella typhimurium LT2
gucggcggcgcguuacgcgaacaacuggaggucggggugaaccuuuccgggccgauggaugucgcgcuucgcgcccagac

SEQ ID NO: 4248229 - RNA, 73 nt, Salmonella typhimurium LT2
ggucacgguuguaaaugacuuuuaugcaacgccgggcauuauccggaugcguauagcauuuacgaugucgacc

SEQ ID NO: 4248230 - RNA, 72 nt, Salmonella typhimurium LT2; identical to SEQ ID NO: 4245881

SEQ ID NO: 4248231 - RNA, 80 nt, Salmonella typhimurium LT2
cgcgcgccgcgcuuucuaccaggcagccacaccgucaugguaaagaucaauggcguaaauagagggucguuggucgcgcg

SEQ ID NO: 4248232 - RNA, 82 nt, Salmonella typhimurium LT2
gcauaaacccaacuggugcggaagauaagguguuuagggcaguuauccugcagggccuuuucucccgccaguuugguuuugc

SEQ ID NO: 4248233 - RNA, 61 nt, Salmonella typhimurium LT2
ugcugacaggaaaggauaguuuaugaaaaagcguuuuaugauguucacuuuacuggcggcg

SEQ ID NO: 4248234 - RNA, 63 nt, Salmonella typhimurium LT2
gcauccaucgccaucagugccgccucuucggucggagccugaggccgcugguggcgacuuugu

SEQ ID NO: 4248235 - RNA, 59 nt, Salmonella typhimurium LT2
ugaaaaauuguaauguacgccggagaugguuugcaucaaagcgccauaacgauuuuuca

SEQ ID NO: 4248236 - RNA, 55 nt, Salmonella typhimurium LT2; identical to SEQ ID NO: 4245909

SEQ ID NO: 4248237 - RNA, 57 nt, Salmonella typhimurium LT2
uugcuggagcgauuucaggagggcaagaaucugcgccugaacgguuuuauccagcga

SEQ ID NO: 4248238 - RNA, 75 nt, Salmonella typhimurium LT2
gugcuauuucucguugauacauggggaggcaguccguuuaaugcugccagccgcauugucgucgauaaagagcgc

SEQ ID NO: 4248239 - RNA, 91 nt, Salmonella typhimurium LT2
gcguagucgauaaaagcuggguggcgcgcguugccgaggugaucgacauuccguuuuguguagcgggcggcauccggucaauugacgacgc

SEQ ID NO: 4248240 - RNA, 72 nt, Salmonella typhimurium LT2
gccggauggcggcugugccuugcccggccuacgaugcuccccguaggccugacacgcacagcgccaucaggc

SEQ ID NO: 4248241 - RNA, 66 nt, Salmonella typhimurium LT2
gggggcggaaccuuugaugugaccguucuggaauacgcuacgccgauuaucgaaguucacgccucc

SEQ ID NO: 4248242 - RNA, 83 nt, Salmonella typhimurium LT2
gccaguuuuugccaggccugcggcgcguuaucgccauagacuuugcgcauccacaguaacagccccagcccuggcguacuggu

SEQ ID NO: 4248243 - RNA, 76 nt, Salmonella typhimurium LT2
gaugcauguuauauucgccgugauggugauguacgucaccuuuuuccucaucggcgcccguaugcgcauguucauc

SEQ ID NO: 4248244 - RNA, 58 nt, Salmonella typhimurium LT2
gagucgauuaguuuccugcgugcuguuaaggcuaaaggcuugcaggaacugguuauuc

SEQ ID NO: 4248245 - RNA, 63 nt, Salmonella typhimurium LT2
gucauuguuggcuuguuuuugcuguuaggcgguuguuccagcggaaugcaaucuaauaauggc

SEQ ID NO: 4248246 - RNA, 65 nt, Salmonella typhimurium LT2
uagccaucaccaucuucuggcagcgcuuccuuucucccguucuccagauuuaucagguggggcug

SEQ ID NO: 4248247 - RNA, 96 nt, Salmonella typhimurium LT2
gacaacgcccacaucaccuguggcagauugaauggaucgacaucuucaucgaccaugaucaccaucuucacauaucccagaccgugcggcgucguc

SEQ ID NO: 4248248 - RNA, 58 nt, Salmonella typhimurium LT2; identical to SEQ ID NO: 4245823

SEQ ID NO: 4248249 - RNA, 59 nt, Salmonella typhimurium LT2
gcaacuccuggugggaucaccggcgcgcguacuacgccagguuacggaccaggagcugc

SEQ ID NO: 4248250 - RNA, 71 nt, Salmonella typhimurium LT2; identical to SEQ ID NO: 4246181

SEQ ID NO: 4248251 - RNA, 66 nt, Salmonella typhimurium LT2; identical to SEQ ID NO: 4246744

SEQ ID NO: 4248252 - RNA, 79 nt, Salmonella typhimurium LT2
agaaaacggcaaagccaugaaggaugacuauguggugcagacguccgccaucgucaaccauuauauggauaaccguucu

SEQ ID NO: 4248253 - RNA, 59 nt, Salmonella typhimurium LT2
ggugacggggcgugagcaugaaauccgcaccaugacggauauucugcugcgccgucgcc

SEQ ID NO: 4248254 - RNA, 96 nt, Salmonella typhimurium LT2
gaccgauggggccaacaucgccgaacguggcgguuuauccccgcuggcgcggggaacacguuacguucgguaaauggaaagcggcgaauaucgguu

SEQ ID NO: 4248255 - RNA, 62 nt, Salmonella typhimurium LT2
ggcaugguaaauaagcggauuuucuccggaccgugagauucaucuaauuugauuacuuugcc

SEQ ID NO: 4248256 - RNA, 58 nt, Salmonella typhimurium LT2
gauugguaacggcguugagcugggggcgaaugucauccugcuuggcgauauuacuauc

SEQ ID NO: 4248257 - RNA, 60 nt, Salmonella typhimurium LT2
ugucauggagauagguaugccaguggcgaaucuggcuaccggcaucgcucuccauuggca

SEQ ID NO: 4248258 - RNA, 91 nt, Salmonella typhimurium LT2; identical to SEQ ID NO: 4246493

SEQ ID NO: 4248259 - RNA, 71 nt, Salmonella typhimurium LT2
gccgucaucaugucguacuugccguuaauccugauggcugucaacugggguuaagggcaaaugcgaauggc

SEQ ID NO: 4248260 - RNA, 75 nt, Salmonella typhimurium LT2
ggcuuguaggccggauaaggcagcaaugugcgccaggauugccugauggcgcugcgcuuaucaggccuacgugcu

SEQ ID NO: 4248261 - RNA, 56 nt, Salmonella typhimurium LT2
ugacuucauccugcaucauaaaacgagccauaucaaagucaugcauggugaaguca

SEQ ID NO: 4248262 - RNA, 88 nt, Salmonella typhimurium LT2
gguggauuugaggccguaguaaguugguaacagagacuuuugccaaaaacgcaaaagacuuugcacauuuugcuaauuucaccgcacc

SEQ ID NO: 4248263 - RNA, 114 nt, Salmonella typhimurium LT2
cagaccaccgcuuuccacgauaccgccaccguccgucaguugcugaauuuacggccgucgccggaguuugaacgcuggcuggaaacgaugggcauuauggcaaacggucgucug

SEQ ID NO: 4248264 - RNA, 72 nt, Salmonella typhimurium LT2
gggagcauaugccguaagccggacaagcgcagcgcuccggcauuaugcgguauuauaucugugcaaccuccc

SEQ ID NO: 4248265 - RNA, 73 nt, Salmonella typhimurium LT2
ugcuggucgacgccugcuacagcccuguagagcguauugccuacaauguugaagcagcgcguguagaacagcg

SEQ ID NO: 4248266 - RNA, 86 nt, Salmonella typhimurium LT2
aaugaggaucaugauuagccugugaugaucuguuuuuuauuacaaaguguagugacaaauucgccaggcuaauagugaauauuauu

SEQ ID NO: 4248267 - RNA, 117 nt, Salmonella typhimurium LT2
ccuuguggagcauauucguggagcaauggcgcguuauauuugucauaaauucgccaauggcggcgaauuacgagcaguaaugguaucugcugaaguugaggauguuauucgcaaagg

SEQ ID NO: 4248268 - RNA, 125 nt, Salmonella typhimurium LT2
uccgccagauagcggucuuccagccccaguucgcgggcaauaaucaucgugaccaugucgccugccccggcgagauggguggcgaugauuucgccuuuaggguugaugauggaggcaucggugga

SEQ ID NO: 4248269 - RNA, 79 nt, Salmonella typhimurium LT2
cugcguauuuuauuaauauauucuucugucgucagucccauugauucugcgcgcgcagaaaggguauuaguauuacagg

SEQ ID NO: 4248270 - RNA, 77 nt, Salmonella typhimurium LT2
cugcgacgaucuguugccggaaaacgugcugaacuacaucaaucagcaggggcuauaccgguaagcacauugcgcag

SEQ ID NO: 4248271 - RNA, 65 nt, Salmonella typhimurium LT2; identical to SEQ ID NO: 4247345

SEQ ID NO: 4248272 - RNA, 81 nt, Salmonella typhimurium LT2
ucgucuuugcguuauaguguuuucaucauaagagcaggagaacacaaugcuaaauguggaaaugcuauccaccggggauga

SEQ ID NO: 4248273 - RNA, 97 nt, Salmonella typhimurium LT2
ccuaauguuuauggccuggugggcggcgaugcuaacgcggucgguccgaagaagcguccgcugucgucgaugucgcccacuaucgucguuaaagagg

SEQ ID NO: 4248274 - RNA, 77 nt, Salmonella typhimurium LT2
ugauuuugacguuuuugcugaacugagcgaacggugggaagccggcgguuacgcucgguucaccgaaggaaaaagcg

SEQ ID NO: 4248275 - RNA, 64 nt, Salmonella typhimurium LT2
uccggucaggauaucgugcguaucaauacccacuuccagacagauacgcgccgucacaaccgga

SEQ ID NO: 4248276 - RNA, 63 nt, Salmonella typhimurium LT2
gccgcauguguucuuuucucuugcuuuaauggccaggcagcggaauugaaacgcguauacggu

SEQ ID NO: 4248277 - RNA, 60 nt, Salmonella typhimurium LT2; identical to SEQ ID NO: 4246655

SEQ ID NO: 4248278 - RNA, 84 nt, Salmonella typhimurium LT2
gcgcggccugguggcaaugaacaugauggaaggcacgcuggugcaaauccgugccaacgccguggucauggcgacaggcggcgc

SEQ ID NO: 4248279 - RNA, 97 nt, Salmonella typhimurium LT2
gauauuccgggauuugcgcugcguuaagaaugagagaaggguuaguuguagcauccugcggcugauacaguuucauugccgcgauaucuccgguauc

SEQ ID NO: 4248280 - RNA, 59 nt, Salmonella typhimurium LT2; identical to SEQ ID NO: 4246234

SEQ ID NO: 4248281 - RNA, 98 nt, Salmonella typhimurium LT2
gcccgauggcgcuucgcuuaucgggccuacaagaauuuaucgcaauauacugauauugcaaauauuguaggccggauaaggcgcagccgccauccggc

SEQ ID NO: 4248282 - RNA, 72 nt, Salmonella typhimurium LT2
gcauugcgcuggaacuuuguaguagcgaucgacaggucgauuuacuacgggaagauuucgacugcguggugc

SEQ ID NO: 4248283 - RNA, 80 nt, Salmonella typhimurium LT2
guuucuuguugaucgcggagaagucgacuucgacguuacggaucucguucucgaucucuuuuucuucguuggucagaaac

SEQ ID NO: 4248284 - RNA, 82 nt, Salmonella typhimurium LT2; identical to SEQ ID NO: 4246328

SEQ ID NO: 4248285 - RNA, 112 nt, Salmonella typhimurium LT2
guucagcuacggguuggggcgcuugagaucaacaaaaacaugcuguuguggaucaacgaugcgcugauggccguguuuuuccuguugauuggccuggaaguuaagcgcgaac

SEQ ID NO: 4248286 - RNA, 62 nt, Salmonella typhimurium LT2
cgcaggauauugaguauuaugacuauaugaaaagcuauaguccuuaugacaaugucaaagcg

SEQ ID NO: 4248287 - RNA, 100 nt, Salmonella typhimurium LT2
uuggcgcagccgcuggauauugccucgcugauucaggcguguccugauuuacugcgccaguccgacacgguugaaugggacgaggcgcagggaacguuga

SEQ ID NO: 4248288 - RNA, 109 nt, Salmonella typhimurium LT2
ggaauucgccagccccacuccgauaucgcgucgugucccagcgugauauucaggcuauaaccaaucaacgcggcaacaacgaucgcgaccugcugacuggcggauugcc

SEQ ID NO: 4248289 - RNA, 74 nt, Salmonella typhimurium LT2
uaucaucgaccaggaagugaaagcgcugauugaacguaacuacaaucgcgcucgucagauccugacugacaaua

SEQ ID NO: 4248290 - RNA, 125 nt, Salmonella typhimurium LT2
gugaguagcggcgcugucugauaagugcauguaggccggauaaggcgaagcggccauccggcggugcagguugccugauggcgcugcgcuuaucaggccuacauuuuuacaguuaccgcacacgc

SEQ ID NO: 4248291 - RNA, 77 nt, Salmonella typhimurium LT2
agcgcgauggacuggugcucggcaugucaguuaaagagaauaugucgcugacggcgcuggacuauuucagccgcgcu

SEQ ID NO: 4248292 - RNA, 85 nt, Salmonella typhimurium LT2; identical to SEQ ID NO: 4247006

SEQ ID NO: 4248293 - RNA, 70 nt, Salmonella typhimurium LT2
gcgcuaacggcuuuagcgcggauaaugugcgcucaacagcauguucucccgcauaagguacuaaaugcgu

SEQ ID NO: 4248294 - RNA, 63 nt, Salmonella typhimurium LT2
cuucuguacugcacguuggcgcggucacuuuuccacugaugguuaauguugcggugucggagg

SEQ ID NO: 4248295 - RNA, 84 nt, Salmonella typhimurium LT2; identical to SEQ ID NO: 4246763

SEQ ID NO: 4248296 - RNA, 57 nt, Salmonella typhimurium LT2
gcauugaaugucugccggaacagguauuuauuaccuccgguuaugcggauucuaugc

SEQ ID NO: 4248297 - RNA, 61 nt, Salmonella typhimurium LT2; identical to SEQ ID NO: 4247441

SEQ ID NO: 4248298 - RNA, 64 nt, Salmonella typhimurium LT2
gaucauugcgaucauuuuuaucgcuucuuccuuaggggcggcgaugagugaaucguucaugauc

SEQ ID NO: 4248299 - RNA, 84 nt, Salmonella typhimurium LT2; identical to SEQ ID NO: 4246283

SEQ ID NO: 4248300 - RNA, 71 nt, Salmonella typhimurium LT2
ggcgaaguauaucgauaaaguaaugacccgccugacccugguuggugcgcuguauauuaccuuuaucugcc

SEQ ID NO: 4248301 - RNA, 119 nt, Salmonella typhimurium LT2
uggagugcugcuuggcuugauuauaucuuuugcuuuaacuguuuuuugggggcuuccacuaacuuacuuaauuaaggcaaauaagggauaaucauaugcuuauaucauuuuguauucca

SEQ ID NO: 4248302 - RNA, 87 nt, Salmonella typhimurium LT2
guggcgacgcuggcguccagaucgcccucaucggcagagacuuuacacccgccgugaugcaacguuggaucgccgcguaaccgccau

SEQ ID NO: 4248303 - RNA, 57 nt, Salmonella typhimurium LT2
uuauccggauggauagacucaaggccagggaacgcuuugagacuaacgccaggauag

SEQ ID NO: 4248304 - RNA, 59 nt, Salmonella typhimurium LT2
uacgggcugcaugacaucgccauguuuaaucugcugaaagugauggaaaucagcuugua

SEQ ID NO: 4248305 - RNA, 78 nt, Salmonella typhimurium LT2
uggcggucggcgauaaaggcuguuuccugaaugcgcccgauauguauauggaaaaacugauugucgguccgggcgcca

SEQ ID NO: 4248306 - RNA, 66 nt, Salmonella typhimurium LT2
guuauagccaaacuggguagugacuaucucccaccccggauguuccuggcuaauuuuggcuuuagc

SEQ ID NO: 4248307 - RNA, 82 nt, Salmonella typhimurium LT2
gugcugcgcuuugcccuguuagggugggucggcugugaaauggccugcggacuugauccauucuggcgccccgacguggugc

SEQ ID NO: 4248308 - RNA, 73 nt, Salmonella typhimurium LT2
ucauguucuggggauuugugggaauugaggcuuuuacgcauuugucgucugaauuuaaaaauccugaacguga

SEQ ID NO: 4248309 - RNA, 67 nt, Salmonella typhimurium LT2
ccgauauggcuaucauugauaaacgucguccgcgcgcgaacguuucucaggugaugcacaucaucgg

SEQ ID NO: 4248310 - RNA, 64 nt, Salmonella typhimurium LT2
ggggaccaguaagugccgguacaguaugggggcgaaaauauuuuugcuccugcuggcggucucc

SEQ ID NO: 4248311 - RNA, 65 nt, Salmonella typhimurium LT2
gcgcgacuuuacccaacgugccaauaucaguggacgcaaugagauggccgcguuggguucugcgc

SEQ ID NO: 4248312 - RNA, 71 nt, Salmonella typhimurium LT2
uuugucggcaucuucaaaacgcugcaugagcugaauuaucgcgguucauuucugauugagauguggacaga

SEQ ID NO: 4248313 - RNA, 64 nt, Salmonella typhimurium LT2
uguggggcuuggcucaaugggaaugggcgcugcgcguucaugccugcgcgccgggcuuuccaca

SEQ ID NO: 4248314 - RNA, 57 nt, Salmonella typhimurium LT2
cacagaauuaacguugggaauuaucagugaugaaaauaaagcggcuuugauuuugug

SEQ ID NO: 4248315 - RNA, 66 nt, Salmonella typhimurium LT2; identical to SEQ ID NO: 4246100

SEQ ID NO: 4248316 - RNA, 76 nt, Salmonella typhimurium LT2
aaaccgcuggaugaugucaaaguucgccaggcguugaccuaugccgugaauaaagaggccaucaucaaagccguuu

SEQ ID NO: 4248317 - RNA, 75 nt, Salmonella typhimurium LT2; identical to SEQ ID NO: 4247693

SEQ ID NO: 4248318 - RNA, 61 nt, Salmonella typhimurium LT2
uugccgcggcugagaguaaauugcgcgccaugcggcgucagcaacauguucagcgcggcga

SEQ ID NO: 4248319 - RNA, 78 nt, Salmonella typhimurium LT2
ggccauuaucuugauauuggugaagacgcaccuguuuugcauuuggaacaguugguauuuuucucuagaggauuggcc

SEQ ID NO: 4248320 - RNA, 68 nt, Salmonella typhimurium LT2
uauagccagacuuaucgcuccuaugugucgccauauccggucguagaaacgagcgguaacuggaaaua

SEQ ID NO: 4248321 - RNA, 63 nt, Salmonella typhimurium LT2
uguacggcagucucgauccugaaucgcccgauuccggcgauucacuacaugauugccgccgca

SEQ ID NO: 4248322 - RNA, 61 nt, Salmonella typhimurium LT2
gaugauuaacgcauaagcgauguuauucagcuucugcgucgcuuucgagcgauacaucauc

SEQ ID NO: 4248323 - RNA, 55 nt, Salmonella typhimurium LT2; identical to SEQ ID NO: 4245798

SEQ ID NO: 4248324 - RNA, 55 nt, Salmonella typhimurium LT2
gaucgguuaggccgggcagguaucgacaaaaucggucuuggcgcgcuaauugguc

SEQ ID NO: 4248325 - RNA, 69 nt, Salmonella typhimurium LT2
guuguacuugucuggucaauaauaacggugcguuuuugucgacuuuaaggcaguauguaauggugcaac

SEQ ID NO: 4248326 - RNA, 56 nt, Salmonella typhimurium LT2
cggcgcgagaggcgaugacgcugcaugaccuugccgcgacguuauccgucgugccg

SEQ ID NO: 4248327 - RNA, 90 nt, Salmonella typhimurium LT2
guuauugccugauggcgcugcgcuuaucaggccuacgagugaaaagcaugguaggccggauaaggcguucacgccgccauccggcaaaac

SEQ ID NO: 4248328 - RNA, 61 nt, Salmonella typhimurium LT2
ugauugaguuucaggugccagccagccaggauuucaggcuggcgcauaaagagcucgacca

SEQ ID NO: 4248329 - RNA, 55 nt, Salmonella typhimurium LT2
cgccgguugagauggagaacgggucgauucugguuuucgauaacggcaaccugcg

SEQ ID NO: 4248330 - RNA, 57 nt, Salmonella typhimurium LT2
ggguuauguuaucauuuguacucguguaacaguacaaacggcgguauaacaugaccc

SEQ ID NO: 4248331 - RNA, 57 nt, Salmonella typhimurium LT2
gcuuccgcguuugucggcgcugugcgcggcaacuacggcggcgaugggcgcggcagc

SEQ ID NO: 4248332 - RNA, 80 nt, Salmonella typhimurium LT2
acugcccguggcggaggugauucaacgcugcagcgaacugggguucggcguuggagaaauuuucgcucugugugggccgu

SEQ ID NO: 4248333 - RNA, 77 nt, Salmonella typhimurium LT2; identical to SEQ ID NO: 4246902

SEQ ID NO: 4248334 - RNA, 61 nt, Salmonella typhimurium LT2; identical to SEQ ID NO: 4246378

SEQ ID NO: 4248335 - RNA, 61 nt, Salmonella typhimurium LT2
gccgaaagcggaaauugucgaucgcugguaugcgcaaacuacggacgauuuccguuuuugc

SEQ ID NO: 4248336 - RNA, 97 nt, Salmonella typhimurium LT2
uucggcaaccugaacguggcgggaugccgguucgucaaagguagaagcaaccacuucgccuuucaccagacgcugcaucucggucacuucuuccgga

SEQ ID NO: 4248337 - RNA, 59 nt, Salmonella typhimurium LT2
agcggguuuuaccauuaccgaugugaacccugauuuugucaucguuggagaaacccgcu

SEQ ID NO: 4248338 - RNA, 60 nt, Salmonella typhimurium LT2
cauuccuaaugccgguaccaucccugccgccauaauggccgccaucggcauauaggaaug

SEQ ID NO: 4248339 - RNA, 79 nt, Salmonella typhimurium LT2
uugugauacgugaauaagcgguagaguaaacccacgcucuccgcaccggguuguaucuuuaaugcuauucgcggcgcaa

SEQ ID NO: 4248340 - RNA, 89 nt, Salmonella typhimurium LT2
ggagcuccccagucuguuaagguuaugcuauucauuuaucaugguuauuuuuauaccggugaagaauaauauaauucuauggaaagccc

SEQ ID NO: 4248341 - RNA, 67 nt, Salmonella typhimurium LT2
ggacgauuuagcgguggucggguuuggcgauagcgaugucagccgggucugccagccgccguuaacc

SEQ ID NO: 4248342 - RNA, 78 nt, Salmonella typhimurium LT2; identical to SEQ ID NO: 4246308

SEQ ID NO: 4248343 - RNA, 59 nt, Salmonella typhimurium LT2
gcaccgcgccgaaggcgaggucagucucuccagccugaccgggcagcacggcgugaugc

SEQ ID NO: 4248344 - RNA, 55 nt, Salmonella typhimurium LT2
ggauaaagacaauuucgaauaccacuauccgcguggguuugacgauugcuuuacc

SEQ ID NO: 4248345 - RNA, 62 nt, Salmonella typhimurium LT2
ggagacuauaaauugcagguuggcgauuuagauaaccgcagcagcuugcaguuuaucgaucc

SEQ ID NO: 4248346 - RNA, 65 nt, Salmonella typhimurium LT2
gugaugaugaccgggauggucucgccgacuuucgcuuuggcgaauccgucgcugucguuauacac

SEQ ID NO: 4248347 - RNA, 83 nt, Salmonella typhimurium LT2
guuguguuacccaaacaacgaucgucacccuuucuacgauaugcuaagcgguaggcugacgcguauuguuguucgggugcaac

SEQ ID NO: 4248348 - RNA, 78 nt, Salmonella typhimurium LT2
ccguaggccugauaagcgcagcgccaucaggcaaccggcacugccggauggcggcuccgccuuauccggccuacaagg

SEQ ID NO: 4248349 - RNA, 59 nt, Salmonella typhimurium LT2
ugaccgugcuggcauuagccgucaacgacagcgacgggcggcgcacguccacacgguua

SEQ ID NO: 4248350 - RNA, 79 nt, Salmonella typhimurium LT2
cugguggauaagcaguauguaccuucgcugagugagggcaucgcgccaggacuuacggaggugggugugaugcugccag

SEQ ID NO: 4248351 - RNA, 74 nt, Salmonella typhimurium LT2
guuuguacgcauauggcggaucuggauuauggcgacuugcgcgucuauccggguaacuaugaugaguauaugac

SEQ ID NO: 4248352 - RNA, 71 nt, Salmonella typhimurium LT2
uguccauacauccggcgucuccugacggaugugaugcaccugcauucgccagggacacugugagguuggca

SEQ ID NO: 4248353 - RNA, 55 nt, Salmonella typhimurium LT2
gaaagggcagauaaaggacaaugccaucgaggcauuacugcacgauccccuuuuc

SEQ ID NO: 4248354 - RNA, 63 nt, Salmonella typhimurium LT2
gugcaggaugacucggcuucgccucgcccuacaggccguugcugacgcaacguuauccuucac

SEQ ID NO: 4248355 - RNA, 79 nt, Salmonella typhimurium LT2
cggauggcgcuacgcuuauccgcccuacgguuucgaccgcaggcccacguuguaggccggauaagcguagcgccauccg

SEQ ID NO: 4248356 - RNA, 78 nt, Salmonella typhimurium LT2
gccaggacccggaaguacgcuauaugccgaguggcggcgcugucgccaacuuaacgcuggcuacuucugaauccuggc

SEQ ID NO: 4248357 - RNA, 60 nt, Salmonella typhimurium LT2
guugaaugccuuacccgguuuguaaaaacgcucaauugcaggucggguaagcguauugac

SEQ ID NO: 4248358 - RNA, 62 nt, Salmonella typhimurium LT2
gcgcaggcgcacugucagcauauuuuugggugaagguaccgcguaacacugcgccugaaugc

SEQ ID NO: 4248359 - RNA, 79 nt, Salmonella typhimurium LT2
ucgacgccauuccguccuuuauccaggaugugaacacccaugggcguuuacuacuggcuaaugggcagcaugaagucga

SEQ ID NO: 4248360 - RNA, 130 nt, Salmonella typhimurium LT2
cgggauaaaggugcuggucagaauguugcguuucacugcuaucggugagcugugaugcacggcggcgcgauagguucgcgccagcccgucaaagcuuacuggcggcucauaccaucuguccaucuguacg

SEQ ID NO: 4248361 - RNA, 68 nt, Salmonella typhimurium LT2
gggugcaguauuuggcaagcugauugaacuugcugguuuuuacuacucaauugucagugcugugaccu

SEQ ID NO: 4248362 - RNA, 96 nt, Salmonella typhimurium LT2
gacgguuuguuguuuaauuuucuccaguuccgauuccagguggccguuaauacuggaauggacuaagguaaauugugauauauagcgaagaucguc

SEQ ID NO: 4248363 - RNA, 62 nt, Salmonella typhimurium LT2
uuccgguagggcacguagaagccggguugcgaaccggcgaucucuauucccccuggccggaa

SEQ ID NO: 4248364 - RNA, 74 nt, Salmonella typhimurium LT2
cgcgacguuucguccagcggcagguaagggaucaccgucacgcggcccagaaaugccgccgggaaaugcuugcg

SEQ ID NO: 4248365 - RNA, 59 nt, Salmonella typhimurium LT2; identical to SEQ ID NO: 4246410

SEQ ID NO: 4248366 - RNA, 78 nt, Salmonella typhimurium LT2
ccgccaccuaugcgcccuaugaguuugucgaugccgauaauaaaauuguugguuucgauauugaugucgccaacgcgg

SEQ ID NO: 4248367 - RNA, 70 nt, Salmonella typhimurium LT2
gauaguuuuaccgccguguuuuucauaaaacugguggguuuuauccagauaacuacggcggaaaauuuuc

SEQ ID NO: 4248368 - RNA, 129 nt, Salmonella typhimurium LT2
uguucggcaugaaucaguugacgaucgccgccguacugucgccaccacuguugcagggcggcaucgcucugcgccguggcgcgaucggucuuauuggcgaugauaauaucggcugaggcgagcugaucg

SEQ ID NO: 4248369 - RNA, 62 nt, Salmonella typhimurium LT2
cgucguguucggcuuuaauuucuucugccggcagcggagcagguucuaccuccggcgcgacg

SEQ ID NO: 4248370 - RNA, 78 nt, Salmonella typhimurium LT2; identical to SEQ ID NO: 4246037

SEQ ID NO: 4248371 - RNA, 70 nt, Salmonella typhimurium LT2; identical to SEQ ID NO: 4245794

SEQ ID NO: 4248372 - RNA, 72 nt, Salmonella typhimurium LT2
ggcgcaagcgccuuaucagucuacaaauuacuuuggcggcucccaaagcguaggccugauaagcgcagcgcu

SEQ ID NO: 4248373 - RNA, 57 nt, Salmonella typhimurium LT2
gaggaucauauugucgcgguacaggucgguaaugaaccgggcgaaaaauugauccuc

SEQ ID NO: 4248374 - RNA, 58 nt, Salmonella typhimurium LT2
ucacuggaguaugaaacaaucguucauauauaagguuuauguugagguaguccgguga

SEQ ID NO: 4248375 - RNA, 56 nt, Salmonella typhimurium LT2
cgcuggcggauauuaccguugacgguacuaccguuccgguuaucuaugcgccagcg

SEQ ID NO: 4248376 - RNA, 79 nt, Salmonella typhimurium LT2
gccauugaccaccgauaucgcgccgggcuaugaccacuucaccuccgggaucggugccgcgaugaucggcugguuuggc

SEQ ID NO: 4248377 - RNA, 84 nt, Salmonella typhimurium LT2; identical to SEQ ID NO: 4246409

SEQ ID NO: 4248378 - RNA, 56 nt, Salmonella typhimurium LT2
gucgcguggcgcgaucgauccccgcauggagcugggucagcgcuuuaucacgcgau

SEQ ID NO: 4248379 - RNA, 63 nt, Salmonella typhimurium LT2
uagcgauaaccugcugaugaucaaugcgcaugucgcacaugauuguacgguagguaaucgcug

SEQ ID NO: 4248380 - RNA, 58 nt, Salmonella typhimurium LT2
cagcuauauuuucgccgccacgcuauuuucauuguuuggccugcuauuuauguggcug

SEQ ID NO: 4248381 - RNA, 59 nt, Salmonella typhimurium LT2
gcuguuaacgcauuuccgcgaccagguaaaacagacggaucuggacgaugcguugcagc

SEQ ID NO: 4248382 - RNA, 85 nt, Salmonella typhimurium LT2
uuaucgccgaagagcgcugcguuuaccuggccuacagaugacguguauuuguaggcccgguuagcguuacgcuaucgggcgauaa

SEQ ID NO: 4248383 - RNA, 59 nt, Salmonella typhimurium LT2
ccuuaugcagaucgccguuggcgcgcuguuggcguggccgacguuugguuugcaugugg

SEQ ID NO: 4248384 - RNA, 81 nt, Salmonella typhimurium LT2
gcggguacaugcgcugcuugaaaagcaucagcuacgcuauaccguagacugguggcuuuccgggcagccguuccugaccgc

SEQ ID NO: 4248385 - RNA, 55 nt, Salmonella typhimurium LT2
ggauuuccgcaacguggugcuggugaugaccaccaacgcuggcgugcgagaaacc

SEQ ID NO: 4248386 - RNA, 77 nt, Salmonella typhimurium LT2; identical to SEQ ID NO: 4246218

SEQ ID NO: 4248387 - RNA, 88 nt, Salmonella typhimurium LT2
gcguaaugaacauaucccguucgaugagaagaucccacucggcauuaugcuggaagugccgucggugauguucaucaucgaucaaugc

SEQ ID NO: 4248388 - RNA, 66 nt, Salmonella typhimurium LT2; identical to SEQ ID NO: 4246543

SEQ ID NO: 4248389 - RNA, 82 nt, Salmonella typhimurium LT2
aacagaucgaacugaucgugggguucuuacagcgggaaagccgcaaaauagaacgcacggucagcauugauaaaccguuguu

SEQ ID NO: 4248390 - RNA, 57 nt, Salmonella typhimurium LT2
gcggcguucuggcagccgugauugccuucugggucaaaauccguccggcgacgccgc

SEQ ID NO: 4248391 - RNA, 64 nt, Salmonella typhimurium LT2
gcgucgucgggucguugcauauuggucgggucaucuccuggaacgguaucgucaccuacggcgc

SEQ ID NO: 4248392 - RNA, 101 nt, Salmonella typhimurium LT2
gugguuucucauguuaacgacgcuggcuucuggcuguucgguaaauuuaccggcgcgaccgaagcgcagacguuaaaaaccuggacgaugauggaaacuau

SEQ ID NO: 4248393 - RNA, 57 nt, Salmonella typhimurium LT2; identical to SEQ ID NO: 4246148

SEQ ID NO: 4248394 - RNA, 84 nt, Salmonella typhimurium LT2
aucaaacgacgcuuaaucguauccuggaugagcuaccuuuauuagagucccgugggcaccagguacugauuagucguggcggau

SEQ ID NO: 4248395 - RNA, 69 nt, Salmonella typhimurium LT2
cagaacgccucgcugguucaggaauccgcagcggccgccgccgcgcuggaagagcaggccagccgucug

SEQ ID NO: 4248396 - RNA, 59 nt, Salmonella typhimurium LT2
ggaaugcgaugaggaucagcgcgacaaaauauuuguuccagugccaguucuuacgcgcc

SEQ ID NO: 4248397 - RNA, 71 nt, Salmonella typhimurium LT2
gcgcugcguucaguuauugcggaagaugguaaagugcuguaccaaaguuauccgcaagcugaacgcgccgu

SEQ ID NO: 4248398 - RNA, 90 nt, Salmonella typhimurium LT2
cggccauuuaucgagaaauuaaugugaguaaguugcgcgauauucugcuggauucgguaguaaccagcucuauuguucucuuacuggucg

SEQ ID NO: 4248399 - RNA, 87 nt, Salmonella typhimurium LT2
cgauuacuagcgauuccgacuucauggagucgaguugcagacuccaauccggacuacgacgcacuuuaugagguccgcuugcucucg

SEQ ID NO: 4248400 - RNA, 57 nt, Salmonella typhimurium LT2
guggccggacuggcucagcuuagccagcagauccaggcucagcuccauguucgccgc

SEQ ID NO: 4248401 - RNA, 79 nt, Salmonella typhimurium LT2
ggcggcaggcgcggacaguagcgucaacauggaggguaaagaaacacgcuuuggcgugcuggccagcagccuguuugcc

SEQ ID NO: 4248402 - RNA, 126 nt, Salmonella typhimurium LT2
cucaaauugcugucuuugauauugaugaagauucauuaccggcccucucuaauaaccgagcguugucagucucaggugucggggaggcugguucucaggucagcaucuuugucgaugguaaauuag

SEQ ID NO: 4248403 - RNA, 68 nt, Salmonella typhimurium LT2
uuaguuuuauuguuagugagugucgcuauuuuguuauuaaauggugggcauuuugcacaagaaauuaa

SEQ ID NO: 4248404 - RNA, 108 nt, Salmonella typhimurium LT2
gcuuuuauggcggaguaugacagcggcgagauugucaucgacccgaaagaacuguuggaagcaaauugguaccguuaugacgaucugccgcuacuaccgccaccgggc

SEQ ID NO: 4248405 - RNA, 63 nt, Salmonella typhimurium LT2
cgugagaaucaauccaacccgcgcugacaaaacacucaccgcgcaggucaaugguuuucaacg

SEQ ID NO: 4248406 - RNA, 60 nt, Salmonella typhimurium LT2
ggcuaccaacauccaguccgucgcggcugaauacgcccggcaacguuuugauggucagcc

SEQ ID NO: 4248407 - RNA, 64 nt, Salmonella typhimurium LT2; identical to SEQ ID NO: 4246045

SEQ ID NO: 4248408 - RNA, 89 nt, Salmonella typhimurium LT2; identical to SEQ ID NO: 4247621

SEQ ID NO: 4248409 - RNA, 77 nt, Salmonella typhimurium LT2
cugcgaagucagugcgcgugcgcgaugaacaucgcgugcugcaugugauuccucaggaguacgccauugacuaccag

SEQ ID NO: 4248410 - RNA, 76 nt, Salmonella typhimurium LT2
uggcgcaguagacgugccuccagaucccggcgcccgugguaagggucgauaaucuggccggcaucgucgcgcgcca

SEQ ID NO: 4248411 - RNA, 93 nt, Salmonella typhimurium LT2
aaugccggauggcgaugcuaacgcgucuuauccggccuacaacgguaucucaccuguaggccggacaaggcguucacgccgccauccggcauu

SEQ ID NO: 4248412 - RNA, 65 nt, Salmonella typhimurium LT2
cccuguguccugugcgguaaucugcugcuaucgagaacgacagacaucgcuaacaguauauaugg

SEQ ID NO: 4248413 - RNA, 55 nt, Salmonella typhimurium LT2
ggguaucgacaccaucauauugugcgggaucucaaccaauaucggcgucgaaucc

SEQ ID NO: 4248414 - RNA, 70 nt, Salmonella typhimurium LT2
ucgguggucggcuggcaauacugacuaugaaaguugaauuucagggugauuuuguccagcuuaucgccga

SEQ ID NO: 4248415 - RNA, 124 nt, Salmonella typhimurium LT2
uguaccggauagagccggacuuuguugccgcucaacuugauuccguguucagcgaugugcgcauugauaccacgaaaaucgggaugcuggcggaaaccgauauugucgaggccguggcggaacg

SEQ ID NO: 4248416 - RNA, 62 nt, Salmonella typhimurium LT2
gguacaccggguuuagcagaaaaaucauccauuugauuauucagcagaauaccgguauuucc

SEQ ID NO: 4248417 - RNA, 87 nt, Salmonella typhimurium LT2
guggggaugccgcugcguguggcugugaccggugccgggcagucgccugcgcuggaugucaccguacaugcgauugguaaaacccgc

SEQ ID NO: 4248418 - RNA, 101 nt, Salmonella typhimurium LT2; identical to SEQ ID NO: 4246552

SEQ ID NO: 4248419 - RNA, 82 nt, Salmonella typhimurium LT2
gccugauggcgcuucgcuuaucaggccuacgacagcgcuggcuguucguaggcuggaucaggcgcuugcgccgccauccggc

SEQ ID NO: 4248420 - RNA, 63 nt, Salmonella typhimurium LT2; identical to SEQ ID NO: 4246391

SEQ ID NO: 4248421 - RNA, 64 nt, Salmonella typhimurium LT2
cagaaugucggugcgcagguuaucgccgacaauaacggucucuuccgagugcgccugcauuuug

SEQ ID NO: 4248422 - RNA, 62 nt, Salmonella typhimurium LT2; identical to SEQ ID NO: 4246165

SEQ ID NO: 4248423 - RNA, 86 nt, Salmonella typhimurium LT2
uauugccauugccgucgcugccgcuaucacccacggcgaucgggcgcgcgucgcccugaugccggacaguagcgguauggccaaug

SEQ ID NO: 4248424 - RNA, 58 nt, Salmonella typhimurium LT2
ugcggguucaaagcgucaaugugcgccagcguuagcgcaucauugcgccggaccugca

SEQ ID NO: 4248425 - RNA, 68 nt, Salmonella typhimurium LT2
uuacccgauggauuucaugucgacgcaagggcaagucauuccccuugcgucaugaaaacgacggguaa

SEQ ID NO: 4248426 - RNA, 56 nt, Salmonella typhimurium LT2
aauguuuugcacccggguugcaggccaaucacccgcagcccugcgcgcagcacguu

SEQ ID NO: 4248427 - RNA, 98 nt, Salmonella typhimurium LT2
ugucguugauugauuguauuuguacaccaauugauauuguugcuaauguucguacaugcgauggugaguacaaaauacuaaaaugaucaucagcgaca

SEQ ID NO: 4248428 - RNA, 81 nt, Salmonella typhimurium LT2
ucguuggcaggugguacaggcauucaccguuugccuuuggcuuaccaucaagcgucaugugcuuauacucacguccgacga

SEQ ID NO: 4248429 - RNA, 73 nt, Salmonella typhimurium LT2
cguccgaacgccgucgcgcguuuugcccguaucgcacaggcgaugggcguagagacgcgcgguaugucugacg

SEQ ID NO: 4248430 - RNA, 65 nt, Salmonella typhimurium LT2; identical to SEQ ID NO: 4246072

SEQ ID NO: 4248431 - RNA, 70 nt, Salmonella typhimurium LT2
cgauguugagcuucaugacauuaauguagcggugaacacccgcaacauuggcuccgggcaguucacgucg

SEQ ID NO: 4248432 - RNA, 128 nt, Salmonella typhimurium LT2
uaggccugccggaugugcgcggucgugagcagauucugaaggugcauaugcgucgcguaccguuagcgacggauauugaugcggcgaucauugcgcgcgguacgccgggcuucuccggugcggaccug

SEQ ID NO: 4248433 - RNA, 74 nt, Salmonella typhimurium LT2
ccucggcccggaugaagucguuaauaaguacggcgugccgccugagcugauuaucgacuuucuggcgcugaugg

SEQ ID NO: 4248434 - RNA, 66 nt, Salmonella typhimurium LT2; identical to SEQ ID NO: 4246144

SEQ ID NO: 4248435 - RNA, 108 nt, Salmonella typhimurium LT2
accggucuggcgcaucgcuuccagcuggcguuggagcauaacggcguacguuggaucaacgacucgaaagcgaccaacgucggcaguaccgaagcggcgcuaaacggu

SEQ ID NO: 4248436 - RNA, 121 nt, Salmonella typhimurium LT2
gcaucaccaccaucuucaacagcuauggcuccgguuugcgccuguggggcaaccguaccgccgccuggccgacgguuacucauaugcguaacuuugagaacgugcgccguacuggugaugu

SEQ ID NO: 4248437 - RNA, 63 nt, Salmonella typhimurium LT2; identical to SEQ ID NO: 4246332

SEQ ID NO: 4248438 - RNA, 113 nt, Salmonella typhimurium LT2
ucggugauguuucugaagccaggcgaucaggugucgguugcggaucuuaauaaaggcaucaucauucagucagguaacgaugccuguaucgcgcuugccgacuacgucgccgg

SEQ ID NO: 4248439 - RNA, 56 nt, Salmonella typhimurium LT2
uacuggucacuauuuuugucaccugcccguuuguggugcgcgaacuggugccagug

SEQ ID NO: 4248440 - RNA, 93 nt, Salmonella typhimurium LT2
cgguuuugauaaaguacaggauguucggcguaucgugcagaacggcgucugcgcgguuggugccuaauuccauguacgcguuaucaauguucg

SEQ ID NO: 4248441 - RNA, 67 nt, Salmonella typhimurium LT2
gcggcggaggaaugaaauagcuuuuuugcgcgucaaccucaaggaagccaaagccuuuuuccguggc

SEQ ID NO: 4248442 - RNA, 65 nt, Salmonella typhimurium LT2
augcuguucagcgaaaaagcgcgcccacucgucauucaccaggaugccguucgucugcaacgcau

SEQ ID NO: 4248443 - RNA, 95 nt, Salmonella typhimurium LT2
aacgguuucgaggguuuaccuuugaaggucggcagcagggugacaccguaguugacuuugcucuugucgauguucgaccaugcccacggaccguu

SEQ ID NO: 4248444 - RNA, 70 nt, Salmonella typhimurium LT2; identical to SEQ ID NO: 4246704

SEQ ID NO: 4248445 - RNA, 56 nt, Salmonella typhimurium LT2; identical to SEQ ID NO: 4247287

SEQ ID NO: 4248446 - RNA, 63 nt, Salmonella typhimurium LT2
ggcgcugcugggcgucgagcaguccauccguauggaaaauuuuuucacgcccggcaguuugcc

SEQ ID NO: 4248447 - RNA, 100 nt, Salmonella typhimurium LT2; identical to SEQ ID NO: 4246106

SEQ ID NO: 4248448 - RNA, 71 nt, Salmonella typhimurium LT2
gcgccagcaugguugcgcccggcaucgccugcgagauagcggcgccgaugcguacccgcaccaucugccgc

SEQ ID NO: 4248449 - RNA, 82 nt, Salmonella typhimurium LT2
cuguggcacguuuaccguuugccaucuggccgccaugcgcuauaucgcugcgcgucagggaagcgaggugauucguuugcag

SEQ ID NO: 4248450 - RNA, 76 nt, Salmonella typhimurium LT2
uaucgccuuugugcgucugccugagcuggugcagggcauuauccucaccgucggcucggcggcguaucuggcgaug

SEQ ID NO: 4248451 - RNA, 65 nt, Salmonella typhimurium LT2
acagcguugauuuuccgcagccgguacgccccagaauagcgacaugcucgccaggauuagccugu

SEQ ID NO: 4248452 - RNA, 100 nt, Salmonella typhimurium LT2
cccguauggacccugcacgggauacggugcugguugaaaauacgccgauugauuaccuggauuuugccucgccggucuccgggcuggguucaaaaauggg

SEQ ID NO: 4248453 - RNA, 56 nt, Salmonella typhimurium LT2
ggucaugcaguagaauugggcaccuaugaugagguguaccauaauccacugcaucc

SEQ ID NO: 4248454 - RNA, 78 nt, Salmonella typhimurium LT2
cugauugcgguuuuuagcuuguguaggccggauaagauacuauccggcuuuuuuauaucaggcaaaaaucgucaucag

SEQ ID NO: 4248455 - RNA, 68 nt, Salmonella typhimurium LT2
guuuccgguauugguaaaucaggucauauugguaaaaaaaucgccgcgacgcuugccaguaccgguac

SEQ ID NO: 4248456 - RNA, 80 nt, Salmonella typhimurium LT2
ggggauugccgggauucugccgaaacugaucggcgguuacuucgauaccgaucagcgcgcggcggggcugggcuuuacuu

SEQ ID NO: 4248457 - RNA, 57 nt, Salmonella typhimurium LT2
uagucuggaaagcuggcuacuccgggggaauggcugucaguggccgcauucagacug

SEQ ID NO: 4248458 - RNA, 55 nt, Salmonella typhimurium LT2
gaaaagucgacggguugaaaaauuacucuauuugucgauucagaagcgacuuuuu

SEQ ID NO: 4248459 - RNA, 61 nt, Salmonella typhimurium LT2
ugaauuuuacccugcaauuccuugaaccugccgaacgccaggcauugcuggauaagauuua

SEQ ID NO: 4248460 - RNA, 93 nt, Salmonella typhimurium LT2; identical to SEQ ID NO: 4246035

SEQ ID NO: 4248461 - RNA, 69 nt, Salmonella typhimurium LT2
gccaacugcgccaguugcgcuucuaugaugucaauaucgacgucgugacgcgcggcggcgcgcgccagc

SEQ ID NO: 4248462 - RNA, 70 nt, Salmonella typhimurium LT2
gcuacaccgcuggcguugaaaccacuacuggcccgcugggucaggguauugccaacgccgucgggauggc

SEQ ID NO: 4248463 - RNA, 60 nt, Salmonella typhimurium LT2; identical to SEQ ID NO: 4246196

SEQ ID NO: 4248464 - RNA, 101 nt, Salmonella typhimurium LT2; identical to SEQ ID NO: 4246046

SEQ ID NO: 4248465 - RNA, 62 nt, Salmonella typhimurium LT2; identical to SEQ ID NO: 4246065

SEQ ID NO: 4248466 - RNA, 59 nt, Salmonella typhimurium LT2
gugacgauugucaucccaauaauguuacaacacgcgcauugucgcgagguaaucgucau

SEQ ID NO: 4248467 - RNA, 62 nt, Salmonella typhimurium LT2; identical to SEQ ID NO: 4247483

SEQ ID NO: 4248468 - RNA, 56 nt, Salmonella typhimurium LT2
gcuauaccacgggaagauggucaggauuucgcucgacucuuccauauugguggagu

SEQ ID NO: 4248469 - RNA, 77 nt, Salmonella typhimurium LT2
cccccggcuugacgguaauacgcuucaccugauagcgcucgcccgcgucgauggagucguauuugccccacgggcgg

SEQ ID NO: 4248470 - RNA, 107 nt, Salmonella typhimurium LT2
gugcugugcggcguuucgucgccccacggucugucccagucggcgcuguagaggcgcugcacgcccuggaacagcaggcgguuggguucgccgucgauccacagcau

SEQ ID NO: 4248471 - RNA, 61 nt, Salmonella typhimurium LT2
aaagaugauguguaggccggguaaggcgcagccgccacccggcauauaugacauucucuuu

SEQ ID NO: 4248472 - RNA, 75 nt, Salmonella typhimurium LT2
cacauguacggguccuuuuuuggcgaauaaucaaccauacauccugauuauuacaauaagggcauguuucaugug

SEQ ID NO: 4248473 - RNA, 79 nt, Salmonella typhimurium LT2
uaucgucguggcauuugccggcccacaucugucacacgcgauguuugccgucuggcuggcccuguugccgcgaauggua

SEQ ID NO: 4248474 - RNA, 66 nt, Salmonella typhimurium LT2
acauggugcgcgguuauauuggcgauaauuucggcaagaaauaccugccggauaacccgaaccagu

SEQ ID NO: 4248475 - RNA, 70 nt, Salmonella typhimurium LT2
ccggugucgcuggggauuuguaccaugcgcacguccaucccggcguagauacgcuccccggcgcguucgg

SEQ ID NO: 4248476 - RNA, 90 nt, Salmonella typhimurium LT2
uuucacucuuuuggcggcuggaagcgcucgguguuuggcgcccugaacguccaugggccggauggcgugcgcuucuauacccggaugaaa

SEQ ID NO: 4248477 - RNA, 71 nt, Salmonella typhimurium LT2
uacggugaacuguggaauaaagguuagcgcauugaccguuaaacgugcgccugcuuccagcaguaaccgug

SEQ ID NO: 4248478 - RNA, 87 nt, Salmonella typhimurium LT2
acguaaggcgcagggcguggaugccccgcugaauaucaucgccugugaaaauauggugcgcggcaccacgcagcugaaaggccacgu

SEQ ID NO: 4248479 - RNA, 118 nt, Salmonella typhimurium LT2
auuucccggcacauccuguggggacuggcccuuaugaggugguggaaaacaauggcuuucaucuacaaaugaaggccuuugaccacuauuucggucugcgcgggcugcuggaugaagu

SEQ ID NO: 4248480 - RNA, 66 nt, Salmonella typhimurium LT2
gcgauuuuuucauaaugccguguaggcucauuaaagauauuuaaagccucaugacgguauaguugc

SEQ ID NO: 4248481 - RNA, 68 nt, Salmonella typhimurium LT2
guuucgcauagaucaucgggaagugcuggcggacaaaaucgucaggcuuguggcugauaucgagaaac

SEQ ID NO: 4248482 - RNA, 61 nt, Salmonella typhimurium LT2
cauccugagaggcuugcagugaagagcuaucgcuauugcccacagcaugcgucucagaaug

SEQ ID NO: 4248483 - RNA, 64 nt, Salmonella typhimurium LT2
ucugcugugggcgguaacgaccggcgguggugaaaaccacuuugcuaucggcucccaucccgga

SEQ ID NO: 4248484 - RNA, 129 nt, Salmonella typhimurium LT2
guuuagcgccggugguaucugcguccaguuccagcucgcgaugucguuauaccgcugggccgcgccgugaauggcgcgcucuacgguauagccgucauuguugagcagcaggaugaccggcgccugccc

SEQ ID NO: 4248485 - RNA, 55 nt, Salmonella typhimurium LT2
uauuuugcaccacagccagccccaggccugucccgucagcuuuggucguaaaaua

SEQ ID NO: 4248486 - RNA, 88 nt, Salmonella typhimurium LT2
cgucggcgacacccugaugacgcuggcguaaggacgaggagcggaaauggaaagucugaacgcccugcuucagggcauggggcugaug

SEQ ID NO: 4248487 - RNA, 77 nt, Salmonella typhimurium LT2
ccugggcuaucgaucgcggcgguuuucuggugggcgcgguguuagccggaaccuuccugccguugguacugaccggg

SEQ ID NO: 4248488 - RNA, 79 nt, Salmonella typhimurium LT2
uccccgcgccagcggggauaaaccggcgaggucaauaaaaaaugguguggcuuuaccguguuccccgcgccagcgggga

SEQ ID NO: 4248489 - RNA, 84 nt, Salmonella typhimurium LT2
cggcaaagaauacgaggucaauggcgcggacaaccugcuacaggcaugucugucccucggccuugauauuccguauuuuugcug

SEQ ID NO: 4248490 - RNA, 70 nt, Salmonella typhimurium LT2
cugggugcucacggauugcugaaggggcgucguuaugucuguuccggcgaucuguggaaagcgguuccgg

SEQ ID NO: 4248491 - RNA, 57 nt, Salmonella typhimurium LT2
ccugcgccagccauucaugaauauaucccgcgaugugucuggcuuugagcuggcagg

SEQ ID NO: 4248492 - RNA, 79 nt, Salmonella typhimurium LT2
ugguuucaccucuggaauugauaaugauaaccaauaucauaugauauauuuucucauuugucagccagggagaaagcua

SEQ ID NO: 4248493 - RNA, 85 nt, Salmonella typhimurium LT2
gugauauggaaaguggcugaaugaagccuuagcgggaggcgguucuguaucccguuaaggccuuauugugccgcggcuucaucac

SEQ ID NO: 4248494 - RNA, 84 nt, Salmonella typhimurium LT2
uuuaccgaccuggaagcggcgcugaucuuugccggagacaaaacacaggcggcaaaaguucagcucguuuucugagaaaguaaa

SEQ ID NO: 4248495 - RNA, 82 nt, Salmonella typhimurium LT2
cgugaugacucaacgcgcugguguuugaccuuucgcucagcaagaguaaagugaaauaauucagacaguugaagcauucaug

SEQ ID NO: 4248496 - RNA, 83 nt, Salmonella typhimurium LT2; identical to SEQ ID NO: 4246346

SEQ ID NO: 4248497 - RNA, 81 nt, Salmonella typhimurium LT2
auggcgguuaucgccgggcuaccgaaagcgccuucuaccuuuaacccgcucuacucgauggaucgggcgauagcgcgccgu

SEQ ID NO: 4248498 - RNA, 67 nt, Salmonella typhimurium LT2
gguuuccgccgccaguuuggggcgguaaaagguguagcuugcgccguccaccguggcgguggacguc

SEQ ID NO: 4248499 - RNA, 66 nt, Salmonella typhimurium LT2
gucgugaaauacaucaagcgucuggugccaaaauaccacuugccagaugcgaucucguuucgcagc

SEQ ID NO: 4248500 - RNA, 57 nt, Salmonella typhimurium LT2; identical to SEQ ID NO: 4245773

SEQ ID NO: 4248501 - RNA, 60 nt, Salmonella typhimurium LT2
gcaggcccuguuugauggcguacagcgggauggcguguaccagaucgcgcagggugaugc

SEQ ID NO: 4248502 - RNA, 57 nt, Salmonella typhimurium LT2
gugccggauggcggcgccugcacguugcgaucuuguaggccaaccgccauccggcau

SEQ ID NO: 4248503 - RNA, 64 nt, Salmonella typhimurium LT2
cgccgcgugcccgcaguucggucugaauccugaauuuaucggaccggcugcgauuacgcuggcg

SEQ ID NO: 4248504 - RNA, 70 nt, Salmonella typhimurium LT2
cugcucaagcgcgucaagauacuggucagcuuuaugcuguuggcgggugacaaucuuguugcagccgcag

SEQ ID NO: 4248505 - RNA, 65 nt, Salmonella typhimurium LT2
ugcaagcgaaacauguuacuuaauggcagguuaucagccugguagcgccuguuuuugcugcugca

SEQ ID NO: 4248506 - RNA, 98 nt, Salmonella typhimurium LT2
caucguaugcaagaacgggcugcggcaagcuggcgaucguucgauagugcgaguauugaaugguugccaguugcggcggauuuuacuuguucaagaug

SEQ ID NO: 4248507 - RNA, 94 nt, Salmonella typhimurium LT2
uacggcgugaugcuggcgggcgucgcggugaugggacgcgucaucugguggauggcgcgaaacuauccgcaacggccaucgcuugcgcgcugua

SEQ ID NO: 4248508 - RNA, 72 nt, Salmonella typhimurium LT2
aaugcugggucauguuauaccgccguuuguacuguuacacgaguacaaaugauaacauaacccgucugcauu

SEQ ID NO: 4248509 - RNA, 62 nt, Salmonella typhimurium LT2
aucacgcacagauuuggcaucggccgggaaaucuaccgguggauucaagucggugcgacgau

SEQ ID NO: 4248510 - RNA, 87 nt, Salmonella typhimurium LT2
gauacaggacgaaccgagaaacagcaguuuguucacguugugcaggugcgcggcgugaauaauguugcucucuaucaucauguuuuc

SEQ ID NO: 4248511 - RNA, 58 nt, Salmonella typhimurium LT2
cuggcaugugguauugauccugaaaagagcacuauuuucguucagucccaugugccgg

SEQ ID NO: 4248512 - RNA, 91 nt, Salmonella typhimurium LT2; identical to SEQ ID NO: 4247455

SEQ ID NO: 4248513 - RNA, 79 nt, Salmonella typhimurium LT2
acgccucuauugccgcugguugugaugcauccgucugaucaauagcgccgcucucauaaccagacgccguggcgggcgu

SEQ ID NO: 4248514 - RNA, 72 nt, Salmonella typhimurium LT2; identical to SEQ ID NO: 4246663

SEQ ID NO: 4248515 - RNA, 99 nt, Salmonella typhimurium LT2
gcugucuaaauaaugucgugaugaugccggauggcgguuggccuacaagaucgcaacgugcaggcgccgccauccggcacaaaauauuacgccaucagc

SEQ ID NO: 4248516 - RNA, 58 nt, Salmonella typhimurium LT2
gccuguuuuugcguaaagagggagaguggcgauuuccgccucuugauaaaacgcaggc

SEQ ID NO: 4248517 - RNA, 74 nt, Salmonella typhimurium LT2
gccugccgggucugcuaugcagccggucgauggcggggaacccccauccgcuaaccguauacggaccucaaggc

SEQ ID NO: 4248518 - RNA, 94 nt, Salmonella typhimurium LT2
uguagcguugugccgauggcgcuaacgcuuaugcugccuacaauggaaaaaucuguaggcccgguaagcguuagcgccaccgggcagugcaacg

SEQ ID NO: 4248519 - RNA, 61 nt, Salmonella typhimurium LT2; identical to SEQ ID NO: 4246629

SEQ ID NO: 4248520 - RNA, 73 nt, Salmonella typhimurium LT2
ccggcuggugaaggcauccgcaugaauagagacaaacaggucggcgcgcuguuucugcgcuuucgccacccgg

SEQ ID NO: 4248521 - RNA, 87 nt, Salmonella typhimurium LT2; identical to SEQ ID NO: 4246310

SEQ ID NO: 4248522 - RNA, 55 nt, Salmonella typhimurium LT2
gaacauugaugagcaaaacgucauuaccaaugccguuuccugcggcacaauguuc

SEQ ID NO: 4248523 - RNA, 73 nt, Salmonella typhimurium LT2
gcuuuuccugcugcucaauaauacguuuaagcugcuuaaguucauuaaaucugauuugcguagcggcaaaacc

SEQ ID NO: 4248524 - RNA, 103 nt, Salmonella typhimurium LT2
gacaucccuucggauuuacguuuuacauuugcaagcggaguaguucgaaccagaagaaucauccagucugaauguugaacacgugaaauccagacuuuuuguc

SEQ ID NO: 4248525 - RNA, 79 nt, Salmonella typhimurium LT2
uguucaauacgucggccuuuaaaccggacaucggcguccauaacgucccauuugucgguuucaaagcgaucguaaggca

SEQ ID NO: 4248526 - RNA, 62 nt, Salmonella typhimurium LT2
ggcaagcauaguguuuugcuaacucacggaaacccgcgaguucgcgauagcuaauguuggcc

SEQ ID NO: 4248527 - RNA, 79 nt, Salmonella typhimurium LT2
ggagaggaccugaugaugcgccggauuuuaucgguauuacuggaaaacgaaucuggggcguuaucgcggguuaucggcc

SEQ ID NO: 4248528 - RNA, 57 nt, Salmonella typhimurium LT2
ucagcacgauacuguaaugccaguugaacauacgccuguuguugcgcaaucugcuga

SEQ ID NO: 4248529 - RNA, 88 nt, Salmonella typhimurium LT2
agcgccccacuaacugcuucgguaaacucggcuauaacuggacggacuccacgccaguaguaagucugcuggagacguuagacgcgcu

SEQ ID NO: 4248530 - RNA, 128 nt, Salmonella typhimurium LT2
cgauauucuuaaaauugauggcaguuuuauucgcaauauagugucaaacagucucgauuaucagauuguggcuucuauuugucauuuagcgcgaaugaaaaauaugcaggucgucgcggaguaugucg

SEQ ID NO: 4248531 - RNA, 61 nt, Salmonella typhimurium LT2
agcggguuaugcgacgugcguggaguaacguauuaugcgucuggcacgaaaauaaucugcu

SEQ ID NO: 4248532 - RNA, 62 nt, Salmonella typhimurium LT2; identical to SEQ ID NO: 4246294

SEQ ID NO: 4248533 - RNA, 70 nt, Salmonella typhimurium LT2
gguauuaugcagcagaugaaugugcggauggucggaaccaccgacgacccgauagauucucuggaauauc

SEQ ID NO: 4248534 - RNA, 104 nt, Salmonella typhimurium LT2
ucuggcgcaaauugaugcggugcuggaaaaacagggcuccaguaagucacguauucuggaugccacuauuuuucugagcgauaaagcggauuuugccgccauga

SEQ ID NO: 4248535 - RNA, 61 nt, Salmonella typhimurium LT2
ccgguuguucaaagugugguaacguuguguuuuuuuauaacucccaucauuuggacaucgg

SEQ ID NO: 4248536 - RNA, 75 nt, Salmonella typhimurium LT2
ucagcgcuuugcucuucuuuccacagugcggcguuaacgcccaugcgcuugaugcgaagcggcauaaugcgcuga

SEQ ID NO: 4248537 - RNA, 63 nt, Salmonella typhimurium LT2
gagcaaaugauuuuaucgcuguucaggaucggcacauccuggauagccauauuauugagguuc

SEQ ID NO: 4248538 - RNA, 80 nt, Salmonella typhimurium LT2
agccgaugagcgaaggcuuucauaugagcaucagcagcaaccuuguuaaguucaugcugaaggcuuauaacgagcagguu

SEQ ID NO: 4248539 - RNA, 72 nt, Salmonella typhimurium LT2
cgucggacagcguugcgugguguuuuacacuaaccgaaggaugcaaagugccauugcaaucgcguggagacg

SEQ ID NO: 4248540 - RNA, 57 nt, Salmonella typhimurium LT2
guccaacugcgcggcaagauuacgcuccuggcuggcuuuuugcugcuccaguuuggc

SEQ ID NO: 4248541 - RNA, 85 nt, Salmonella typhimurium LT2
gaucaaagcgcuggagcgcguuggcgcagauauuguucguguuucuguaccgacaauggacgccgccgaagcguucaagcuuauc

SEQ ID NO: 4248542 - RNA, 79 nt, Salmonella typhimurium LT2
uccggcgauagaagccacugcgccacgauauccaugguugauagacgucgucaugguauugauggcgccugaacccgga

SEQ ID NO: 4248543 - RNA, 56 nt, Salmonella typhimurium LT2; identical to SEQ ID NO: 4245948

SEQ ID NO: 4248544 - RNA, 77 nt, Salmonella typhimurium LT2
guucugaccgugaauugccggauggcgccguaggccggauaagacgguuacgcgccaucaggcaaaacaacaggagc

SEQ ID NO: 4248545 - RNA, 57 nt, Salmonella typhimurium LT2; identical to SEQ ID NO: 4246368

SEQ ID NO: 4248546 - RNA, 70 nt, Salmonella typhimurium LT2
ggcgcugcgcuuaucaggccuacguaaugcguugauauuuuggguucuguaggccggauaaggcggaacc

SEQ ID NO: 4248547 - RNA, 61 nt, Salmonella typhimurium LT2
gguccgccagaggcuguacagagaauccggcaaaauuaccguuguccagccgcugguagcc

SEQ ID NO: 4248548 - RNA, 71 nt, Salmonella typhimurium LT2
cggcgggagggguaggcaaaagacgcagaauggaaagcgccgucacgcuuuucccugacccugacucgccg

SEQ ID NO: 4248549 - RNA, 63 nt, Salmonella typhimurium LT2
cgaugaaguuuaucaaaggugacgcuauugccggcaucauuauuaucuuugugaacuuuauug

SEQ ID NO: 4248550 - RNA, 69 nt, Salmonella typhimurium LT2
cggaacaguucuacguacaacgugcccaguccggagaggaaacgguugggaacgguacguaaaaugccg

SEQ ID NO: 4248551 - RNA, 64 nt, Salmonella typhimurium LT2
guugucgcgauucuggagcaacauccgcugcugggugccggauuugcccauaaaaucgaacaac

SEQ ID NO: 4248552 - RNA, 82 nt, Salmonella typhimurium LT2
aggugacgauagacgguacguugacuacgccggugauugaacuggcagcuggcgaagauagcgguacuguuggcgaucgccu

SEQ ID NO: 4248553 - RNA, 67 nt, Salmonella typhimurium LT2; identical to SEQ ID NO: 4247525

SEQ ID NO: 4248554 - RNA, 65 nt, Salmonella typhimurium LT2; identical to SEQ ID NO: 4246555

SEQ ID NO: 4248555 - RNA, 56 nt, Salmonella typhimurium LT2
cucgugaagaucagcagagcggggagacuuuucuccccgacggcuucuucacgcag

SEQ ID NO: 4248556 - RNA, 97 nt, Salmonella typhimurium LT2
gccugucggggagaaguggucauuuaugauaagcguuuguugaccaaaaacuacggacagcguuuacugaaugccuuaccuguuuuuccgauagagc

SEQ ID NO: 4248557 - RNA, 62 nt, Salmonella typhimurium LT2; identical to SEQ ID NO: 4246611

SEQ ID NO: 4248558 - RNA, 73 nt, Salmonella typhimurium LT2; identical to SEQ ID NO: 4246230

SEQ ID NO: 4248559 - RNA, 57 nt, Salmonella typhimurium LT2
ugcugguaugacgcgccguuaagccgcuguucccacucugcggcgcgguuaccggca

SEQ ID NO: 4248560 - RNA, 128 nt, Salmonella typhimurium LT2
ccgcagcccguugucagguaacgcccaucguuuauuucaccguucccuuauauguugcgcuuaugucgauacaucaggcgguaguaucagggaaaagguguauaacgcggcguugucgugugucgcgg

SEQ ID NO: 4248561 - RNA, 65 nt, Salmonella typhimurium LT2
gacccagcgcgauauaagaaggcuuagcggcgagcgcgacgucuaucuccauaucaucguggguc

SEQ ID NO: 4248562 - RNA, 70 nt, Salmonella typhimurium LT2
ggaucggcauggcgauagacauaaaccgguuuucgcgcauuuuugacaacuuuaucuaccgcgccgguuc

SEQ ID NO: 4248563 - RNA, 92 nt, Salmonella typhimurium LT2
gccucggugcguauugacgccgaugugauggaguggcugaaacggccaggaaaaggcuaccagacgcggcucaaugccauucugcgcgaggc

SEQ ID NO: 4248564 - RNA, 68 nt, Salmonella typhimurium LT2
gugguuuauccgcagauccagcacggccuugaaguuauccagcgcccgcuucaucugcggauuuuuac

SEQ ID NO: 4248565 - RNA, 63 nt, Salmonella typhimurium LT2; identical to SEQ ID NO: 4246228

SEQ ID NO: 4248566 - RNA, 63 nt, Salmonella typhimurium LT2
ccgcacgcugucguccgugagugacuaucauucccguggucaagucaccgguuacagcgucgg

SEQ ID NO: 4248567 - RNA, 74 nt, Salmonella typhimurium LT2
acguggggcaucggggaugagugugucgauagucagcguaaagcgggcugauucgcuacuuucgccuuucacgu

SEQ ID NO: 4248568 - RNA, 79 nt, Salmonella typhimurium LT2; identical to SEQ ID NO: 4246469

SEQ ID NO: 4248569 - RNA, 58 nt, Salmonella typhimurium LT2; identical to SEQ ID NO: 4247462

SEQ ID NO: 4248570 - RNA, 76 nt, Salmonella typhimurium LT2
guauggcgaaguuuuacucucuuacgggcgucaggugauauuccuggcguuggcuaagggguaaaaaauguuuuac

SEQ ID NO: 4248571 - RNA, 67 nt, Salmonella typhimurium LT2; identical to SEQ ID NO: 4246473

SEQ ID NO: 4248572 - RNA, 55 nt, Salmonella typhimurium LT2
gggcuuaugcacuaaauaagacuuuagcgcuugcuaauauuuagggcguaagucc

SEQ ID NO: 4248573 - RNA, 61 nt, Salmonella typhimurium LT2
uccgacugcugcugaaucagcgccagcgcauuaucguagcgcuucaggaacagcaguccgg

SEQ ID NO: 4248574 - RNA, 64 nt, Salmonella typhimurium LT2
ucgcuggcgauuuagcgaugaaggcugcggauguacacaucgguuuucucgauagauuuagcgg

SEQ ID NO: 4248575 - RNA, 68 nt, Salmonella typhimurium LT2
cgccugucguagguuuuacggcuuguggaaagguugugcagccauauagcaauaaacuuauccaggcg

SEQ ID NO: 4248576 - RNA, 80 nt, Salmonella typhimurium LT2; identical to SEQ ID NO: 4246838

SEQ ID NO: 4248577 - RNA, 76 nt, Salmonella typhimurium LT2
guaggcuauggcagguuucuuuggcgcugauauuaagcgaaacgagcccgcuggcgcugaggaaaucgucauccac

SEQ ID NO: 4248578 - RNA, 82 nt, Salmonella typhimurium LT2
gauggcgacgauaaucauguauggcguuuguaccgauaacaccaggcuguguuuauaggcgcuaagcugauccggcgucauu

SEQ ID NO: 4248579 - RNA, 80 nt, Salmonella typhimurium LT2
gucggggggcgcuagcgcuuaccugaccuacaaaaucaagcagacgauguaggccggguaaggcguagccgccacccggc

SEQ ID NO: 4248580 - RNA, 84 nt, Salmonella typhimurium LT2
gcugcaaaugggauuucgcaaagcggguuccagcgauaucgucaaugucgaacagugccccguuuuggcgccccagcuugcagc

SEQ ID NO: 4248581 - RNA, 67 nt, Salmonella typhimurium LT2; identical to SEQ ID NO: 4246226

SEQ ID NO: 4248582 - RNA, 71 nt, Salmonella typhimurium LT2
ugcuguucugcaacaccagcggcgcauaauaguucauuacguuaacgccugugaacuguugcaaaacggcg

SEQ ID NO: 4248583 - RNA, 67 nt, Salmonella typhimurium LT2; identical to SEQ ID NO: 4246444

SEQ ID NO: 4248584 - RNA, 55 nt, Salmonella typhimurium LT2
uguugcaccaaaauagugcuuuaaugugaacauuaagcaccacauuggugcaaca

SEQ ID NO: 4248585 - RNA, 56 nt, Salmonella typhimurium LT2
uggcgcuuauuuuugugcuacuggcaaaaauucugguggucagcgaacuggcguua

SEQ ID NO: 4248586 - RNA, 86 nt, Salmonella typhimurium LT2
ucuaccgcuuucaucagaccgauguugccuuccugaaucagaucaaggaauugcaagccacgguugguguauuucuuagcgauaga

SEQ ID NO: 4248587 - RNA, 80 nt, Salmonella typhimurium LT2
cggauggcgccgcuucgcgucuuauccggccuacgagugagcaucuguuuacaggccggauaaggcgcagccgccauccg

SEQ ID NO: 4248588 - RNA, 80 nt, Salmonella typhimurium LT2
gccgugaugacggcguugaaguucgucauaucgugggcgcuaucgcuaacgaaggcgacaucagcagccguuacauuggc

SEQ ID NO: 4248589 - RNA, 55 nt, Salmonella typhimurium LT2
gaagcugaugauuaauaaaaagggcguaaugcccuuuuuuuacgccaacagcuuu

SEQ ID NO: 4248590 - RNA, 73 nt, Salmonella typhimurium LT2
gcugaagaaguuuauagugaaaaaauggaugucuauaucgauuguuuuaauaaacuucaauugcccguucagc

SEQ ID NO: 4248591 - RNA, 78 nt, Salmonella typhimurium LT2
ccaccuguuucauggcgauaaugccgcgguuagagugguugccgaacugaucgaggucguuacgcucaaauugggugg

SEQ ID NO: 4248592 - RNA, 67 nt, Salmonella typhimurium LT2
ggcugagcggcuggcgaaacuggcgcuggaugagcuuccucucgccugguuuuauagccguauuguc

SEQ ID NO: 4248593 - RNA, 58 nt, Salmonella typhimurium LT2
gcuggccguauugcuuagccuguugaucgguuauaucgccuggcuggcaacggccagc

SEQ ID NO: 4248594 - RNA, 56 nt, Salmonella typhimurium LT2; identical to SEQ ID NO: 4246331

SEQ ID NO: 4248595 - RNA, 122 nt, Salmonella typhimurium LT2
gggcagacuuucgguaagagagaaaaucggguauggcaugggugacgccggauguaacauuauuuuuggcgcuaucaugcuguuuguuaauuacuuuuauacggauauuuuuggucuugccc

SEQ ID NO: 4248596 - RNA, 63 nt, Salmonella typhimurium LT2; identical to SEQ ID NO: 4247535

SEQ ID NO: 4248597 - RNA, 80 nt, Salmonella typhimurium LT2
ggcgaauggcugcuguaucgugcccacgugaagggcgaaaguaccgaagcgcuggugccgaacaugguagccaccucgcu

SEQ ID NO: 4248598 - RNA, 59 nt, Salmonella typhimurium LT2
cgcguuauucugcgcgcgcucuaucgagcguaucggugaccguugccagaauaucugcg

SEQ ID NO: 4248599 - RNA, 90 nt, Salmonella typhimurium LT2; identical to SEQ ID NO: 4246253

SEQ ID NO: 4248600 - RNA, 78 nt, Salmonella typhimurium LT2
uucagagaguagugcaguuacagcuuuuacggggauaaguaauguuuuaaauauuguaccuuuuucuuauucuuugag

SEQ ID NO: 4248601 - RNA, 97 nt, Salmonella typhimurium LT2; identical to SEQ ID NO: 4245787

SEQ ID NO: 4248602 - RNA, 100 nt, Salmonella typhimurium LT2
caguaccaccgguuuauugcauuucacggucagaucgaggaaauaagcggucucuuccaucguaucaguaccgugggugaucacgaaaccgucggugcug

SEQ ID NO: 4248603 - RNA, 66 nt, Salmonella typhimurium LT2; identical to SEQ ID NO: 4246160

SEQ ID NO: 4248604 - RNA, 62 nt, Salmonella typhimurium LT2
gcuguagcgacucuucgccggugacguacagcguuuucaucugcucggcgagcuugcacagc

SEQ ID NO: 4248605 - RNA, 55 nt, Salmonella typhimurium LT2
uauccuggcguuagucucaaagcguucccuggccuugagucuauccauccggaua

SEQ ID NO: 4248606 - RNA, 60 nt, Salmonella typhimurium LT2
caggaaucacaggcggcuuaucugcugcgcaagcaugaagugagccgucuggauaucgug

SEQ ID NO: 4248607 - RNA, 57 nt, Salmonella typhimurium LT2
guccagcagguggucgccauauagcgcaaggggacgaguaugaaaccacugcuggac

SEQ ID NO: 4248608 - RNA, 125 nt, Salmonella typhimurium LT2
uaucagguuccgccgggugacgagcagcgaucucaaaugcuuugggcaccaccgauucaaauuugaugauaucggcaaugucauaaacaaaagaaagcggcuuaccacuauggauaaaaccgaua

SEQ ID NO: 4248609 - RNA, 80 nt, Salmonella typhimurium LT2
cgcuauucgccguuggcgcaaggccugguuuuccgcgcccaucaaagcggaacgcacagccuuucgucgggcgguaugcg

SEQ ID NO: 4248610 - RNA, 129 nt, Salmonella typhimurium LT2
ggacuuuucgguagcgggauuaacuggguuuaugucaguaucgcgcaguuuggcggcaugccgggcccgguuaacguuuuucugguggugcugcuugcagcuuaucucucgcuguauaccggacuguuu

SEQ ID NO: 4248611 - RNA, 80 nt, Salmonella typhimurium LT2
cgcaacucaggcgccgcaaccggcgaauguacugcuggagguaaacgaucuucguguuacguucgcuacgccugauggcg

SEQ ID NO: 4248612 - RNA, 84 nt, Salmonella typhimurium LT2; identical to SEQ ID NO: 4246214

SEQ ID NO: 4248613 - RNA, 56 nt, Salmonella typhimurium LT2
ggugugcaaagacugauagccguucgcuuugggaauggcaauauagucuuucaccc

SEQ ID NO: 4248614 - RNA, 62 nt, Salmonella typhimurium LT2
ggcugggcgcugaacugaacgaugaagaggcugauauuuucgccgaugguuacaacgccgcc

SEQ ID NO: 4248615 - RNA, 68 nt, Salmonella typhimurium LT2
ggcguucgaguuaggcgaucaugagccggauuucgaaacccggcugcaugagcugggcuaugaaugcc

SEQ ID NO: 4248616 - RNA, 93 nt, Salmonella typhimurium LT2
cugaauacgcuggaagagaaguuggcgcaguuggaauuccgccggauguucuccggcgaguacgauagcgccgauugcuaucucgauauucag

SEQ ID NO: 4248617 - RNA, 73 nt, Salmonella typhimurium LT2
guggcagaaugugcuguucgauguagccaaucagcaaccgcgcgcccguuucaugcauuggacagcacgccac

SEQ ID NO: 4248618 - RNA, 55 nt, Salmonella typhimurium LT2
cgcgcguuuacccagcucaaacugcagcacauccaguuuaauguggugaaugccg

SEQ ID NO: 4248619 - RNA, 63 nt, Salmonella typhimurium LT2
cgugaugaaaucggcgcgcauauggaacugcaggcgcuaagguaugcggcaaugauuucaacg

SEQ ID NO: 4248620 - RNA, 62 nt, Salmonella typhimurium LT2; identical to SEQ ID NO: 4246623

SEQ ID NO: 4248621 - RNA, 69 nt, Salmonella typhimurium LT2; identical to SEQ ID NO: 4246621

SEQ ID NO: 4248622 - RNA, 57 nt, Salmonella typhimurium LT2
ucgcaauuuuccgggccugcgccuugucauucggggugacggagucuucaagaucga

SEQ ID NO: 4248623 - RNA, 60 nt, Salmonella typhimurium LT2; identical to SEQ ID NO: 4246115

SEQ ID NO: 4248624 - RNA, 64 nt, Salmonella typhimurium LT2
uuucgucuggcauuaucgaucaguaccagucgucuuaucuugauugaagccgaugccggugaaa

SEQ ID NO: 4248625 - RNA, 74 nt, Salmonella typhimurium LT2
cgaauuugaacccgcaucacugccgaucaccucuucaauggucggcauugauguugguuuaaaagauuuguucg

SEQ ID NO: 4248626 - RNA, 65 nt, Salmonella typhimurium LT2
gccgcgauggcuuucauuuccagccccgugccgguuugauugggaaugaagccaaucugcgaggc

SEQ ID NO: 4248627 - RNA, 73 nt, Salmonella typhimurium LT2
ugccuacguugacuacgcugaaaaauggacggcuaaacuggucguaccacaauuagcguauuaacggagagca

SEQ ID NO: 4248628 - RNA, 57 nt, Salmonella typhimurium LT2
gugcggccuggugguugaaggcggucauccggggcugcaaaaugaacaggcgcgcgc

SEQ ID NO: 4248629 - RNA, 110 nt, Salmonella typhimurium LT2
gcggggaagaccgccggacccugaauguguccugggauggccgggugcagugcagacucacccugccggaaacggugacacucagccgggggccgcuguuacugcccugc

SEQ ID NO: 4248630 - RNA, 60 nt, Salmonella typhimurium LT2; identical to SEQ ID NO: 4246519

SEQ ID NO: 4248631 - RNA, 61 nt, Salmonella typhimurium LT2
gaccggauuguggccgacagguugagucaugcuucccugcuggaggccgcuaaucugaguc

SEQ ID NO: 4248632 - RNA, 79 nt, Salmonella typhimurium LT2
cgcacgaccgaaagucgcuguacugcgcgagcagggggugaacucucacguggagauggcggcggcguuccaucgugcg

SEQ ID NO: 4248633 - RNA, 84 nt, Salmonella typhimurium LT2
cugcguaccacuuccggcgucauugccguggauaaagagagcgggaagguuaucuggcaugcagggccggaagucguagcgcag

SEQ ID NO: 4248634 - RNA, 66 nt, Salmonella typhimurium LT2
cugcgugguguucaugcugugacgcguuacaucguuaacgaaguccaggauguauaccgucugcag

SEQ ID NO: 4248635 - RNA, 110 nt, Salmonella typhimurium LT2
uguugacugucugcauugccugauggcgcugugcgugucaggccuacggggagcaucguaggccgggcaaggcacagccgccauccggcgugaugugaggcaaaaaugca

SEQ ID NO: 4248636 - RNA, 56 nt, Salmonella typhimurium LT2
cugugguugaggcggaaccgguaguggaagaagcgccgguuguggaaaaaccgcag

SEQ ID NO: 4248637 - RNA, 102 nt, Salmonella typhimurium LT2
gcuuuuuuugcugagagcucgugggcaacaauauuccgacucaggcgggcaaccuggucgcagauacgauuuugcuccaacgguucuccccgcgcgagaagu

SEQ ID NO: 4248638 - RNA, 70 nt, Salmonella typhimurium LT2
uacaaaaacuaucggcaaucgagcgugaagaguuaaagcuuuucgcgcuggauuuguugauggaacugua

SEQ ID NO: 4248639 - RNA, 63 nt, Salmonella typhimurium LT2
uggucgucugcguaagcugaacauggggccagaguucuugucggcguuuaccguaggcgacca

SEQ ID NO: 4248640 - RNA, 85 nt, Salmonella typhimurium LT2; identical to SEQ ID NO: 4246245

SEQ ID NO: 4248641 - RNA, 68 nt, Salmonella typhimurium LT2
uaaaaauccagaguauuaauuuucgugguccccaugaggggcgaugagauuaauacacuggagauuua

SEQ ID NO: 4248642 - RNA, 90 nt, Salmonella typhimurium LT2
guuugacaggcagucaauauuuauucauggaaugaaaaucaguuugcagcagcacauuccaggaauaaguauccagagugucggucaggc

SEQ ID NO: 4248643 - RNA, 64 nt, Salmonella typhimurium LT2
guuguucgauuuuaugggcaaauccggcacccagcagcggauguugcuccagaaucgcgacaac

SEQ ID NO: 4248644 - RNA, 83 nt, Salmonella typhimurium LT2
uaguuuaugaauugacgccggaauauucagguuggaaauuuauuacgcauauucaugaccucaauuuucugcucaaugugcug

SEQ ID NO: 4248645 - RNA, 66 nt, Salmonella typhimurium LT2; identical to SEQ ID NO: 4246048

SEQ ID NO: 4248646 - RNA, 84 nt, Salmonella typhimurium LT2
gcccggauacggauaaagcguuguucuggggaaauaugucggauacgacauccgucaacggaaaaacgcugcaucguccguggc

SEQ ID NO: 4248647 - RNA, 66 nt, Salmonella typhimurium LT2
uucgccgcuggaucugcgccgaaugauggaugcgccaggacagcauuucuugcaggcuacggcgaa

SEQ ID NO: 4248648 - RNA, 77 nt, Salmonella typhimurium LT2
cgcuuucacaccagaaccuggcucaucagugauuuuauuugucauaaucauugcugagacaggcucuguagagggcg

SEQ ID NO: 4248649 - RNA, 71 nt, Salmonella typhimurium LT2
gcgcguaacgaucagcuuuuugccgaaauugacgaucucaauggcggccaggaagcgauagaggagcgcgc

SEQ ID NO: 4248650 - RNA, 93 nt, Salmonella typhimurium LT2
ccggcgagcugacguuaggcggcgacaacagcuauuccggcgccaccacuaucacugacggcacgcugauugccgccaacgucaacgcgcugg

SEQ ID NO: 4248651 - RNA, 59 nt, Salmonella typhimurium LT2; identical to SEQ ID NO: 4246107

SEQ ID NO: 4248652 - RNA, 64 nt, Salmonella typhimurium LT2; identical to SEQ ID NO: 4246098

SEQ ID NO: 4248653 - RNA, 71 nt, Salmonella typhimurium LT2; identical to SEQ ID NO: 4227861

SEQ ID NO: 4248654 - RNA, 76 nt, Salmonella typhimurium LT2
aaauguggcaaaccuguugguuuacguuauggcuguacggcacacccauaacgacaauuaauaaugugcuacguuu

SEQ ID NO: 4248655 - RNA, 56 nt, Salmonella typhimurium LT2
cgauauugaugccgauguggugaucauuggcgguggcuuuucaggcaucaauaccg

SEQ ID NO: 4248656 - RNA, 80 nt, Salmonella typhimurium LT2
uaccgggcguauucucaacgugaaugucccggaucuaccguuagcgcagguuaaaggcauucgcgugacucgcuguggua

SEQ ID NO: 4248657 - RNA, 100 nt, Salmonella typhimurium LT2; identical to SEQ ID NO: 4246518

SEQ ID NO: 4248658 - RNA, 84 nt, Salmonella typhimurium LT2
gggaucagcaguucggcgccgucgaugauuuuggucacggaaaccggaccuuugucaucggcuggcagcacggugaugcuuucc

SEQ ID NO: 4248659 - RNA, 97 nt, Salmonella typhimurium LT2
cggacuugccuuccauccguugugugggauaccgccagauguggucauacauugagggcgaaaucucauaugaugaaaugguuuauagagguguuug

SEQ ID NO: 4248660 - RNA, 70 nt, Salmonella typhimurium LT2
uauugaagcgcucuccgaucgcgcaucgccguugccgcauaugaugccgcgcccggaagcguuugcggua

SEQ ID NO: 4248661 - RNA, 74 nt, Salmonella typhimurium LT2; identical to SEQ ID NO: 4246734

SEQ ID NO: 4248662 - RNA, 74 nt, Salmonella typhimurium LT2
ccauucucgaucguaugccgggcgaugcguggcaaaaauucgccaaccugcgcgccuauuaugguuggaugugg

SEQ ID NO: 4248663 - RNA, 81 nt, Salmonella typhimurium LT2
gcgaacuccagcagcaggaugccgaaagcccguuaaugauugaugaaagccgcuuucaggccuccuggugugguaaagcgc

SEQ ID NO: 4248664 - RNA, 78 nt, Salmonella typhimurium LT2
ugcgguuaacgugaacuauagcgugcagaacgccggcgaaaaaccgcuggaagucuccaccuuuggucaguuaaaaca

SEQ ID NO: 4248665 - RNA, 76 nt, Salmonella typhimurium LT2
gcccgguggcgcugcgcuuaccaggccuacacguugcgacaaccuguaggccggauaagcauuagcgccauccggc

SEQ ID NO: 4248666 - RNA, 62 nt, Salmonella typhimurium LT2
auauucauccagccagaccggcuguuugucaucgcgcagacgccaggucagcggauggguuu

SEQ ID NO: 4248667 - RNA, 80 nt, Salmonella typhimurium LT2; identical to SEQ ID NO: 4245910

SEQ ID NO: 4248668 - RNA, 72 nt, Salmonella typhimurium LT2
cagauagccgguuucccgggcgcggaaacuaucgccagcgaugcguucuggcgucuggagauggauauucug

SEQ ID NO: 4248669 - RNA, 126 nt, Salmonella typhimurium LT2
gcugauugaacacuuuggccgucgcugccagggcugguuugaggaugacgacggccaucgcgagcagugcgauuuucgcuuucgcuucaaaaacugcccgcaguguaaugccgaaaacgauauugc

SEQ ID NO: 4248670 - RNA, 59 nt, Salmonella typhimurium LT2
gguaccggaagugguggugacggcgaucauuuucgcuuucacgcccauuuucgggaacu

SEQ ID NO: 4248671 - RNA, 66 nt, Salmonella typhimurium LT2; identical to SEQ ID NO: 4246670

SEQ ID NO: 4248672 - RNA, 65 nt, Salmonella typhimurium LT2
ugcgcaaguagauaacgccuucuuacuacaaagguaauaagaccagauacguuauuacaugcgca

SEQ ID NO: 4248673 - RNA, 129 nt, Salmonella typhimurium LT2
uggcugaggggucaaguggucagguaucaagcuuccuugauggcgguaaccccuuccguuucuggcugcuugaaauauucaacggaaauauuauugcuaucgggcugauuccugugcuugcgcugauua

SEQ ID NO: 4248674 - RNA, 128 nt, Salmonella typhimurium LT2
ggcauuacugcccguaauaggcauucgcgccguguuuacgcagauaguguuuaucgagcaguucaggcugcauauccgguagcugcggggccagcuggcgcgagaacagccccauauaggcacacucc

SEQ ID NO: 4248675 - RNA, 73 nt, Salmonella typhimurium LT2
ugaguaaggcaagagcgcuuuuugauugauuuuuuccagacuaucaauaaaguaagugccugcgccuugcuua

SEQ ID NO: 4248676 - RNA, 60 nt, Salmonella typhimurium LT2; identical to SEQ ID NO: 4246687

SEQ ID NO: 4248677 - RNA, 80 nt, Salmonella typhimurium LT2; identical to SEQ ID NO: 4246407

SEQ ID NO: 4248678 - RNA, 58 nt, Salmonella typhimurium LT2; identical to SEQ ID NO: 4246683

SEQ ID NO: 4248679 - RNA, 58 nt, Salmonella typhimurium LT2; identical to SEQ ID NO: 4245763

SEQ ID NO: 4248680 - RNA, 68 nt, Salmonella typhimurium LT2
ggcgauaauguguugacggauacugucaaaaauuucguuagcgguuuuuccgucgaucauuauugacc

SEQ ID NO: 4248681 - RNA, 65 nt, Salmonella typhimurium LT2
cgugcaaacugcggcccgccuguugagccugcuucgcagcgcgcucaaagaggccugguuugccg

SEQ ID NO: 4248682 - RNA, 55 nt, Salmonella typhimurium LT2
ccguuaacguuuuacgcugccgauacuccauugucggcagcgaguuacguugcgg

SEQ ID NO: 4248683 - RNA, 77 nt, Salmonella typhimurium LT2
ccgccaauaugaaaaccuuguacuuauuguuaccguuacucauacccggugcaaaguaauaggguuuucuuguaagg

SEQ ID NO: 4248684 - RNA, 60 nt, Salmonella typhimurium LT2
ccggacugcuguuccugaagcgcuacgauaaugcgcuggcgcugauucagcagcagucgg

SEQ ID NO: 4248685 - RNA, 79 nt, Salmonella typhimurium LT2; identical to SEQ ID NO: 4246206

SEQ ID NO: 4248686 - RNA, 83 nt, Salmonella typhimurium LT2; identical to SEQ ID NO: 4245938

SEQ ID NO: 4248687 - RNA, 65 nt, Salmonella typhimurium LT2
gcugguuguugucuguggucgugaacugcugucugacaaguauuucccgcuggucaacaaagagc

SEQ ID NO: 4248688 - RNA, 60 nt, Salmonella typhimurium LT2
auuuuucugcugauugccgcggcgcugcuguggcagcuggcgcgcaacgcgcagggggau

SEQ ID NO: 4248689 - RNA, 65 nt, Salmonella typhimurium LT2
uuuuacuuaacgguugaugacacguauucaguaaggugauaaauuguccgacuguuaacguaaaa

SEQ ID NO: 4248690 - RNA, 122 nt, Salmonella typhimurium LT2
guuaacgcuguagugccggauggcggcgaaacgccuuauccggccuacucuugagccagaugucgccagauguaggccugauaagcguagcgccaucaggcauaaaccuaucaggcguugac

SEQ ID NO: 4248691 - RNA, 58 nt, Salmonella typhimurium LT2
ggccgcacagcuuaacagcggucugaaaaagcuauccggaucguugcuguccguggcc

SEQ ID NO: 4248692 - RNA, 56 nt, Salmonella typhimurium LT2; identical to SEQ ID NO: 4246309

SEQ ID NO: 4248693 - RNA, 64 nt, Salmonella typhimurium LT2
uuguuaaugcaaacacauucuuuauggaaaaacaaagcacccuggaauguuacugcauuggcaa

SEQ ID NO: 4248694 - RNA, 56 nt, Salmonella typhimurium LT2
gcgugcguauacguaaucuugaacagaguaucaaucugagauugcuguaucguagu

SEQ ID NO: 4248695 - RNA, 64 nt, Salmonella typhimurium LT2; identical to SEQ ID NO: 4246210

SEQ ID NO: 4248696 - RNA, 57 nt, Salmonella typhimurium LT2
acugggcaaagaagauaagcuggucgccaugcaccaccugcccggcuuuguucacgu

SEQ ID NO: 4248697 - RNA, 62 nt, Salmonella typhimurium LT2
cagccgaacgugaaaagaaagacggcaagaaaaagccgccguucuggacgcguaucgcgcug

SEQ ID NO: 4248698 - RNA, 69 nt, Salmonella typhimurium LT2
ugguagguauggacagcaagcuuuccggcauccuggauaugcuggaagaagccacuauccaacucaccg

SEQ ID NO: 4248699 - RNA, 71 nt, Salmonella typhimurium LT2
ggaaagaaucauucuugucuuucgcacggcgaacaaauuccggaauguguuuaacagagcugauuucuucc

SEQ ID NO: 4248700 - RNA, 60 nt, Salmonella typhimurium LT2; identical to SEQ ID NO: 4246402

SEQ ID NO: 4248701 - RNA, 88 nt, Salmonella typhimurium LT2
cagguucgaaucuuccauaucgcagauagcaaaaaagcgccuuuagggcgcuuuuuuacauuggugggucgugcaggauucgaaccug

SEQ ID NO: 4248702 - RNA, 63 nt, Salmonella typhimurium LT2
uacgagaacagcacgugcgagccugauggcguugcgcuaucaggcuauccggcuuuuaacgug

SEQ ID NO: 4248703 - RNA, 70 nt, Salmonella typhimurium LT2
uaccaauuugcaaauuagcuucguccauucccgcuaucgcaaugaaaacgucgcgauuugcguguuggua

SEQ ID NO: 4248704 - RNA, 63 nt, Salmonella typhimurium LT2
ccgcucuucaagcauuuccgagagauuuauccagagauggaacucucucuuguugaagagggg

SEQ ID NO: 4248705 - RNA, 71 nt, Salmonella typhimurium LT2; identical to SEQ ID NO: 4245955

SEQ ID NO: 4248706 - RNA, 78 nt, Salmonella typhimurium LT2
uugccgauucaauugaagcgauaaaaagcggcguuaccgauaaauauaaacuuuuuauuguuguugaauccguggcgg

SEQ ID NO: 4248707 - RNA, 58 nt, Salmonella typhimurium LT2
aguguccgggcaccgaaguacgugaagaauacaagcguggcuucggugugccgacgcu

SEQ ID NO: 4248708 - RNA, 66 nt, Salmonella typhimurium LT2; identical to SEQ ID NO: 4246029

SEQ ID NO: 4248709 - RNA, 95 nt, Salmonella typhimurium LT2
ugauccugcccgauggcgcugcgcuuaucaggccuacauccguugaggaucuguaggccggauaagacgcgucgcgucgccauccggcacgguca

SEQ ID NO: 4248710 - RNA, 58 nt, Salmonella typhimurium LT2
uucugauuuauuugaagcuccaggcgaugaccugcaugaagcuuuggauaaauuugaa

SEQ ID NO: 4248711 - RNA, 96 nt, Salmonella typhimurium LT2; identical to SEQ ID NO: 4246155

SEQ ID NO: 4248712 - RNA, 91 nt, Salmonella typhimurium LT2
gccagacgccgcgguuauucagcccgcguuucuguuccggcugaauuaaugcccgacaaugcgggcacugaauacgcgcggccucgcuggc

SEQ ID NO: 4248713 - RNA, 76 nt, Salmonella typhimurium LT2
cggguggcggcuacgccuuacccggccuacaucgucugcuugauuuuguaggucagguaagcgcuagcgccccccg

SEQ ID NO: 4248714 - RNA, 79 nt, Salmonella typhimurium LT2
gaucucgccgauccugaucccguuuaucguggcgacguugguacgccugauucagggaucggggacgguggcgaugauc

SEQ ID NO: 4248715 - RNA, 64 nt, Salmonella typhimurium LT2
gcuuacguaaaacugcgcauggcgugagacgcuauucuugugggugcgugauguuuuauugagc

SEQ ID NO: 4248716 - RNA, 55 nt, Salmonella typhimurium LT2
gugagggcgucgauggcccggcgguauuuuucuuucagggcuaucaccccuucgc

SEQ ID NO: 4248717 - RNA, 122 nt, Salmonella typhimurium LT2; identical to SEQ ID NO: 4245921

SEQ ID NO: 4248718 - RNA, 65 nt, Salmonella typhimurium LT2
uuacgccaucucuucuggcggccucaugcggugaacgccgcggucgucugaaggaugaagcguaa

SEQ ID NO: 4248719 - RNA, 76 nt, Salmonella typhimurium LT2
gauccacugcgcgcugcgccaguugcuccggcccaagcucuuccgccggagcauuaauggugucgcgcacccaguc

SEQ ID NO: 4248720 - RNA, 65 nt, Salmonella typhimurium LT2
ggcaaaagugugaacaucucauccggccuacggucgucuguaggccgacuguucaccacuacgcc

SEQ ID NO: 4248721 - RNA, 55 nt, Salmonella typhimurium LT2
cccggaauccaccaugauccccuguucaaacagcgcauccaugaugguuuccggg

SEQ ID NO: 4248722 - RNA, 72 nt, Salmonella typhimurium LT2; identical to SEQ ID NO: 4246503

SEQ ID NO: 4248723 - RNA, 59 nt, Salmonella typhimurium LT2
caguacgugcugaacgauauucauuuguugucauggauggguuuuuucagcaugggcug

SEQ ID NO: 4248724 - RNA, 73 nt, Salmonella typhimurium LT2
aaaucggcgguaccgucggugauaucgaaucgcugccguuucuugaggcgauucgucaauuggcgguagauau

SEQ ID NO: 4248725 - RNA, 65 nt, Salmonella typhimurium LT2
ggaaugaugcaggugcuggcggacgaauaccagaaccguucucugcguguuaacugcauuaaccc

SEQ ID NO: 4248726 - RNA, 57 nt, Salmonella typhimurium LT2
acagcgcuucccugcugguggcguuuauucuuagcguuauuaaggcgauagugcugu

SEQ ID NO: 4248727 - RNA, 58 nt, Salmonella typhimurium LT2
gguauuaauccugcgcuggcuacguacacagucaaacacgaccagcgacaguaguauc

SEQ ID NO: 4248728 - RNA, 92 nt, Salmonella typhimurium LT2
guugucgugcuguucacuccacugcugcgguaaugcagaguaaaaaucuuuacuauauugcauuccccaguaaauguagaucucacgacgac

SEQ ID NO: 4248729 - RNA, 108 nt, Salmonella typhimurium LT2
uuuuguuaccgccggugcaaaaacauuugacgcugaaguugcugccgcauuuacguuuuucccggaugccgggcggcggguuuagcgcggguacuggcgguggcgaaa

SEQ ID NO: 4248730 - RNA, 64 nt, Salmonella typhimurium LT2
ccguaucguacaggcgguggccggaggcauuaucgcuggcuucggcgcgcgucuggcgaugggg

SEQ ID NO: 4248731 - RNA, 62 nt, Salmonella typhimurium LT2
gguauggcgucaauuucacccacugugcaggcagcggcgaacggguggaugacaccaugacc

SEQ ID NO: 4248732 - RNA, 84 nt, Salmonella typhimurium LT2
guaggccggauaaggcguucacgccgccauccggcaucguguucguaaaaauaccggauggcggcuucgccuuauccggccuac

SEQ ID NO: 4248733 - RNA, 126 nt, Salmonella typhimurium LT2
guuccgaucuguuccgcgaucugccgaaaguucaguacgaucugauugucacuaacccgccuuaugucgaugcggaggauauguccgaucugccgaacgaauaucgccacgaaccugagcuggggc

SEQ ID NO: 4248734 - RNA, 82 nt, Salmonella typhimurium LT2
acucgcuacaaacuuuuaacccuuaccgcuaguuuuaucucauugccauuaacggggugagacgcguggauaacggagcagu

SEQ ID NO: 4248735 - RNA, 60 nt, Salmonella typhimurium LT2
cugcaacggcgcgucgaacagcaugguuuucccgucgaccugaucgauguacguuugcag

SEQ ID NO: 4248736 - RNA, 65 nt, Salmonella typhimurium LT2; identical to SEQ ID NO: 4246049

SEQ ID NO: 4248737 - RNA, 67 nt, Salmonella typhimurium LT2
gcuaaauccuuauaugcgcguuggggagcaguuaauggaaguccugaugcugcauaaagggaugagc

SEQ ID NO: 4248738 - RNA, 87 nt, Salmonella typhimurium LT2; identical to SEQ ID NO: 4246260

SEQ ID NO: 4248739 - RNA, 93 nt, Salmonella typhimurium LT2
uccgcugaaacgcgcccugcgugcggauaaaaugacgcuggcggcgcuggaggcaacguuacgucuguaucugcacccggaagcguuggcgga

SEQ ID NO: 4248740 - RNA, 69 nt, Salmonella typhimurium LT2; identical to SEQ ID NO: 4246703

SEQ ID NO: 4248741 - RNA, 71 nt, Salmonella typhimurium LT2
auggugaaauugcuggaagcgacgcaguaucgucuggugacgaagaugacccgucccggcgaauuuaccgu

SEQ ID NO: 4248742 - RNA, 70 nt, Salmonella typhimurium LT2
gcuggaagccuggugcgccgagcaagauuccgggcugaagcucaaucuucauccgcgcgcccaugccagc

SEQ ID NO: 4248743 - RNA, 66 nt, Salmonella typhimurium LT2
gcagaaaggcuuucuuuauaggagucgggggcaauuacgauuuucauagugguagccuguuacugc

SEQ ID NO: 4248744 - RNA, 65 nt, Salmonella typhimurium LT2
guagauuccagccguuugaauguagaaacgaaccugccggaagcauucgaacgcugcgaauuuau

SEQ ID NO: 4248745 - RNA, 101 nt, Salmonella typhimurium LT2; identical to SEQ ID NO: 4246508

SEQ ID NO: 4248746 - RNA, 56 nt, Salmonella typhimurium LT2
uccagcaaaaaucuuucuuuagagagugcgaucgauaaagagagugacuugcugga

SEQ ID NO: 4248747 - RNA, 64 nt, Salmonella typhimurium LT2; identical to SEQ ID NO: 4245828

SEQ ID NO: 4248748 - RNA, 56 nt, Salmonella typhimurium LT2
gccguuagcguuagagauugaaaggcaggggagcgccuugucguugacguuaacgc

SEQ ID NO: 4248749 - RNA, 77 nt, Salmonella typhimurium LT2; identical to SEQ ID NO: 4245888

SEQ ID NO: 4248750 - RNA, 58 nt, Salmonella typhimurium LT2; identical to SEQ ID NO: 4246412

SEQ ID NO: 4248751 - RNA, 66 nt, Salmonella typhimurium LT2
uuugcccggauacuucgcguggauagcaucggcaaaacgacgcgccaguucgagauccggcguaga

SEQ ID NO: 4248752 - RNA, 60 nt, Shigella flexneri 2a str. 2457T
gggauaggcgacgcaaugaugaugccuguugcucggccggccuuacugcgugcuuauccu

SEQ ID NO: 4248753 - RNA, 62 nt, Shigella flexneri 2a str. 2457T
ggcugguagaacgcgccaaucauguuuuuaccgaggggaugguugaccgcaguuuugccgcc

SEQ ID NO: 4248754 - RNA, 63 nt, Shigella flexneri 2a str. 2457T
cuuaucaggccuacaagaugauugcaauauauugaauuugcacgauuuuguaggccggauaag

SEQ ID NO: 4248755 - RNA, 84 nt, Shigella flexneri 2a str. 2457T
ucgcgcaauuuagcgacccauuuugccgguucccaauauugcaccugagaaucguguaaaccggucguuaccaguaaaugcgga

SEQ ID NO: 4248756 - RNA, 81 nt, Shigella flexneri 2a str. 2457T
uuccguauggugagguacuacgguuuuuugaguccggcgaaacggcgguuacuggaagaagugguguacaucauaacggag

SEQ ID NO: 4248757 - RNA, 60 nt, Shigella flexneri 2a str. 2457T
uugcauugcguaaacgcuuuuuauuuacaaaaaaauggggaaguguuacagcgauugcga

SEQ ID NO: 4248758 - RNA, 66 nt, Shigella flexneri 2a str. 2457T
gugggcguuucacuuucugcucgacaauaucacgcccgauauccagcaaauugugauagcgcacac

SEQ ID NO: 4248759 - RNA, 119 nt, Shigella flexneri 2a str. 2457T
gcuggaguggcugauccguaaagacggcuguaugcacugugaagauccgggcugccugaaggcgugcccgucugcuggugcaaucauucaguacgcuaacgggauugucgauuuccagu

SEQ ID NO: 4248760 - RNA, 130 nt, Shigella flexneri 2a str. 2457T
cgcgggcauuauugaugcaauggccgaaaauaugcgcagucggaugcugaccaugggcgauucgguggugaaaauuucccucgccucgcuggucgguuugcugaccauagccgucuaucuggugcuggug

SEQ ID NO: 4248761 - RNA, 88 nt, Shigella flexneri 2a str. 2457T
gcuuuugccggaugcgucuacgccuuauccggccuacggguagauacgucucguaggccugauaagcgcagcgcaucaggcguaaagc

SEQ ID NO: 4248762 - RNA, 105 nt, Shigella flexneri 2a str. 2457T
gcccuuucaucagcucggguaaauacucaaacauuagcugggccuccgcucaaaacgugucgcgcgcaggucaaugcguuugagaauguacugacugagcagggu

SEQ ID NO: 4248763 - RNA, 59 nt, Shigella flexneri 2a str. 2457T
gcauaucuuugguuugcaucgguuuuaccguguaggcacgaugcaacguaaagauacgc

SEQ ID NO: 4248764 - RNA, 73 nt, Shigella flexneri 2a str. 2457T
ggcgcacggcagcauguugacccuggaaauuaccucuggcguggucgcgguggucggcauucugcuggcagcc

SEQ ID NO: 4248765 - RNA, 114 nt, Shigella flexneri 2a str. 2457T
ggcaucgaacaagcaauccguuuuuuaagccagcaguuucguggcggcaccgaucuugccaguuguuuucgcgccauuauggaacgcuugcaaagcagggaaugguuugaugcc

SEQ ID NO: 4248766 - RNA, 110 nt, Shigella flexneri 2a str. 2457T
gcgucagguuucugcgccgcugguauuaauuguggugaacaacaacggcgggcaaauuuucucgcuguugccaacgccgcaaagcgagcgugagcguuucuaucugaugc

SEQ ID NO: 4248767 - RNA, 63 nt, Shigella flexneri 2a str. 2457T
uacgguuguugguggugcggguguagccugcgcuaaagguuuucucgcguccgcgauagcgua

SEQ ID NO: 4248768 - RNA, 83 nt, Shigella flexneri 2a str. 2457T
ggucgauaauaccguuacgcugcggugccagguaggugacuucgaaaccuucgcgcuccagcugacggcaaguauccaguacc

SEQ ID NO: 4248769 - RNA, 68 nt, Shigella flexneri 2a str. 2457T
gaagauuugaucgguucugguucuuuaaccgguucuggaaucgguugauaccaggccgcaaguuguuc

SEQ ID NO: 4248770 - RNA, 57 nt, Shigella flexneri 2a str. 2457T
ucagcgacaacucuugcugagcugccccaggaucgcuuagucgguguugucgugcga

SEQ ID NO: 4248771 - RNA, 95 nt, Shigella flexneri 2a str. 2457T
ugcaguaccguuguuacccgcagcgauuguugccguagaggugaacacgcccaucaccauugccgcagcaauagcuguuuuaacaaacuuacuca

SEQ ID NO: 4248772 - RNA, 66 nt, Shigella flexneri 2a str. 2457T
ccacgauuaucaccuguugcccuuugcgcaugaauuacgcaaacguggggugaauaaucgcauugg

SEQ ID NO: 4248773 - RNA, 75 nt, Shigella flexneri 2a str. 2457T
gcaguccuauaacagucaugaugaugagguuggcgguaauaugucccugaccuaugauggcucuuauggcacggu

SEQ ID NO: 4248774 - RNA, 65 nt, Shigella flexneri 2a str. 2457T; identical to SEQ ID NO: 4228215

SEQ ID NO: 4248775 - RNA, 79 nt, Shigella flexneri 2a str. 2457T
caugcucaccacguagucuuuaccgcugucgauuagugaacggaucaggcagugaauuucuacguuauugucagucaug

SEQ ID NO: 4248776 - RNA, 57 nt, Shigella flexneri 2a str. 2457T
ggggcaucguuacgcgugucagcaccgaucaggauguuggcgagcagauggugaauc

SEQ ID NO: 4248777 - RNA, 117 nt, Shigella flexneri 2a str. 2457T
gccacuuuugucugcgggaugugacaccaguuguuguuuucguuaauuccaccauccggugaaguauagccaagacaacccaugauggugucguacagcucuacgugacggcguggc

SEQ ID NO: 4248778 - RNA, 59 nt, Shigella flexneri 2a str. 2457T
uucugcuugagaucgcacugucagcauuaucgcugcugcuuugcggccuucaggcagaa

SEQ ID NO: 4248779 - RNA, 97 nt, Shigella flexneri 2a str. 2457T; identical to SEQ ID NO: 4228584

SEQ ID NO: 4248780 - RNA, 75 nt, Shigella flexneri 2a str. 2457T
gccagggucagaugguuccggcguucgauaaaguuguguucucuuguccgguacuggagccaaccggcccgcugc

SEQ ID NO: 4248781 - RNA, 83 nt, Shigella flexneri 2a str. 2457T
ccguaauaccauggugcgcuggguaucagaaauggcagacaaacuccguccucuguauauagcgcugaaugacuauguucugg

SEQ ID NO: 4248782 - RNA, 69 nt, Shigella flexneri 2a str. 2457T
uuacguugguagguuugugcauuugccggaucguauuuuaucaacgcaucacgaauauuaucgacguaa

SEQ ID NO: 4248783 - RNA, 55 nt, Shigella flexneri 2a str. 2457T
gugugcaaagacugauagccguucgcuuuuggaauggcgauguagucuuucacgc

SEQ ID NO: 4248784 - RNA, 59 nt, Shigella flexneri 2a str. 2457T
ggaauaccaucaauaucgugaguguugucagcauuuucaccgguauuugaggcuguuuc

SEQ ID NO: 4248785 - RNA, 62 nt, Shigella flexneri 2a str. 2457T
gcacaguacguuucuauuccgguugccgacgguggcgaaggaacgguggaagcgaugauugc

SEQ ID NO: 4248786 - RNA, 62 nt, Shigella flexneri 2a str. 2457T
cuuaucaggccuacgucauauugcaauuuauugaauuugcacgaacuuguaggccggauaag

SEQ ID NO: 4248787 - RNA, 76 nt, Shigella flexneri 2a str. 2457T
cggauuuaucggugcgcugguagccgguuggggcucggacaaauuguuuaacggcaaccgugggccgaugaauuug

SEQ ID NO: 4248788 - RNA, 87 nt, Shigella flexneri 2a str. 2457T
auggcgucaggcaaacaaauauaaaguuccgcgcauugcguucguuaacaaaauggaccgcgugggugcgaacuuccugaaaguugu

SEQ ID NO: 4248789 - RNA, 87 nt, Shigella flexneri 2a str. 2457T
uguugagcuauaccgugggaagucugcuuggcccgucauuuagcgcuaugcuaaugcagaauuucuccgauaauuuauuguuuauca

SEQ ID NO: 4248790 - RNA, 92 nt, Shigella flexneri 2a str. 2457T
uacuugccaaaguaaaacaguguaaaagguauguaacagaccauugacugacugaauggucugucauacuuuguuaccugcaaaggggagua

SEQ ID NO: 4248791 - RNA, 64 nt, Shigella flexneri 2a str. 2457T
gaaacgcaucgguaugauugcgccagaagcgguggcuuugcguaucaucaacccgaugcgcuuc

SEQ ID NO: 4248792 - RNA, 71 nt, Shigella flexneri 2a str. 2457T
aacgaugcggacaucaugcccgaggucgcgcagugugccauccgcgacuucggucagggugucguucaguu

SEQ ID NO: 4248793 - RNA, 117 nt, Shigella flexneri 2a str. 2457T
ugccgcuggcgagaaccgcgaaacguggacguagcggaauaucggcgugauugcggguccagauuucauucacuacgccauuuuuacaggucacuuuuuucacuucaucgcccggca

SEQ ID NO: 4248794 - RNA, 113 nt, Shigella flexneri 2a str. 2457T
cugguugugaggguguugaugccgucuuuguagccaucauuuagcgcuugcugcuucugcugcaacugcugguuguuggcugcuaugcggcucuguauuuccuggcgcuucag

SEQ ID NO: 4248795 - RNA, 58 nt, Shigella flexneri 2a str. 2457T
guugcagcguuuucggcaacgcgcaccaaaagugcguuuaucguugcaggcgcugaac

SEQ ID NO: 4248796 - RNA, 63 nt, Shigella flexneri 2a str. 2457T; identical to SEQ ID NO: 4227622

SEQ ID NO: 4248797 - RNA, 84 nt, Shigella flexneri 2a str. 2457T
gcguccaugacauuuugcuguuuucgccuucgcacaaagcacgcuuggugacgaaguugagaauaccgccgguguuguuaucgc

SEQ ID NO: 4248798 - RNA, 102 nt, Shigella flexneri 2a str. 2457T
cggacuugauugguggcgugagcaaaagcggugaccgcuaugucgaccacaccauguucgauauggugcagucgcugacuauugcugacagccuuaaguuug

SEQ ID NO: 4248799 - RNA, 78 nt, Shigella flexneri 2a str. 2457T; identical to SEQ ID NO: 4228279

SEQ ID NO: 4248800 - RNA, 58 nt, Shigella flexneri 2a str. 2457T; identical to SEQ ID NO: 4227764

SEQ ID NO: 4248801 - RNA, 69 nt, Shigella flexneri 2a str. 2457T
ugcuggcgaugcgucucugaacaggcggccucacagguguggcagccgauacagagcguggagucggca

SEQ ID NO: 4248802 - RNA, 69 nt, Shigella flexneri 2a str. 2457T
ugcgaccgcaucggccugguguaccgugggaaauuaaucgccagcgguacgccggacgauuugaaagca

SEQ ID NO: 4248803 - RNA, 55 nt, Shigella flexneri 2a str. 2457T
gauuuuuuugcuggcuaucauggaaaccauuuacgugguuaccggcaaaacaauc

SEQ ID NO: 4248804 - RNA, 56 nt, Shigella flexneri 2a str. 2457T
cugccaguuccgcugauuuacguuggugauaagaacgugaaagcgguugcaggcgg

SEQ ID NO: 4248805 - RNA, 85 nt, Shigella flexneri 2a str. 2457T
acugcauaguaauuuguuugaguaaauacuguauggccuggaagcuauauuucgggccguauugauuuucuugucacuaugaggu

SEQ ID NO: 4248806 - RNA, 82 nt, Shigella flexneri 2a str. 2457T
caacacgaaggcgcauuuccgguauccauaaagagucggucuugucugugaaauuuaaauggugggagugcgcuuccgguug

SEQ ID NO: 4248807 - RNA, 96 nt, Shigella flexneri 2a str. 2457T
uuaauuccugaacugugccggaugcgcuucgcuuauccggccuacacgcgaugccaggucagauaagcgaaacgcauccggcauuacacugauuaa

SEQ ID NO: 4248808 - RNA, 59 nt, Shigella flexneri 2a str. 2457T; identical to SEQ ID NO: 4227117

SEQ ID NO: 4248809 - RNA, 69 nt, Shigella flexneri 2a str. 2457T
guugacuuucugacccacuucgaugaacgcuuuugcguccgggcuuggggugcgguagaaaguaccaac

SEQ ID NO: 4248810 - RNA, 61 nt, Shigella flexneri 2a str. 2457T
ugucggcggcgguucccugcauuggcgcguuaauggcugcacguucagccgcugcacgacg

SEQ ID NO: 4248811 - RNA, 60 nt, Shigella flexneri 2a str. 2457T
aggcuuuccgccugccgauaacgccugagauccggcggauuaucgacgagcagaaagccu

SEQ ID NO: 4248812 - RNA, 70 nt, Shigella flexneri 2a str. 2457T
aacgcuucaaugccgguuaacugacuauauucacauugcaaaguauauucgguuaauggcgucuugcguu

SEQ ID NO: 4248813 - RNA, 64 nt, Shigella flexneri 2a str. 2457T
ucgucuauguggcguucaucauugauguguuugccggauacaucguggggugccauggaaacga

SEQ ID NO: 4248814 - RNA, 90 nt, Shigella flexneri 2a str. 2457T
guaaauguagaaaacugcauucugguugaugacucaguugccggugcgcaaucugguaucgacgcagguauggaaguguucuacuucugc

SEQ ID NO: 4248815 - RNA, 56 nt, Shigella flexneri 2a str. 2457T
cggaguugaucuuucgcgcgucaccguuggucacugcgaucugaaagacaaccucg

SEQ ID NO: 4248816 - RNA, 69 nt, Shigella flexneri 2a str. 2457T
gccuuauccggccuacaaaaucgugcuaauucaaaauguugcauuauaugcuguaggccugauaagcgc

SEQ ID NO: 4248817 - RNA, 78 nt, Shigella flexneri 2a str. 2457T
gcgacggcgaucgcgugauuaugguugaccaugaaggcaauaaagucgauggcgaucagaucauguauaucaucgcgc

SEQ ID NO: 4248818 - RNA, 74 nt, Shigella flexneri 2a str. 2457T
uaaauacgucacuucaacuaugcuguuugucuauauugugaucauuauuggcaugguguggaguauucguuuua

SEQ ID NO: 4248819 - RNA, 84 nt, Shigella flexneri 2a str. 2457T
ucugguucgaucaucugucaacugacgugauccaucaggugguggauaaauucaucgucgaguugcagguucagcuggaucaga

SEQ ID NO: 4248820 - RNA, 73 nt, Shigella flexneri 2a str. 2457T
cagauucagcaggaagaugccacucaauugcggcacauuugccugacagauguggcacuucccgcugaugaug

SEQ ID NO: 4248821 - RNA, 97 nt, Shigella flexneri 2a str. 2457T
aucguggcugauaaacaaauaggccaguugaugcuuuuguugcaaugauuucaaaagcgucaauauuugcgccuguaccguuuugucgagugaugau

SEQ ID NO: 4248822 - RNA, 92 nt, Shigella flexneri 2a str. 2457T
cgccgggaacagaauaacgucgcggaugguauggcuguuggugaacagcauuaccauacggucgaugccaauccccagaccugcugucggcg

SEQ ID NO: 4248823 - RNA, 90 nt, Shigella flexneri 2a str. 2457T
augaauccgcgcugaauggcggaguguuggucaaaauguaaacgcauauugacuauacuuacgccauugagguaaaaaacagcguuucau

SEQ ID NO: 4248824 - RNA, 117 nt, Shigella flexneri 2a str. 2457T
ucaccugcugauuaucguccugcuguuauugcuguuaacgcuggugcuggcgggccugguacggauggcugcgcggguguuaauggcgaaaccgccgcaggccguuaaccgggguga

SEQ ID NO: 4248825 - RNA, 78 nt, Shigella flexneri 2a str. 2457T
gaggccuauuuugccgagugcgaccgugacagcgucuacccggaacguuuugucaaagcacuggcggauauggguauc

SEQ ID NO: 4248826 - RNA, 62 nt, Shigella flexneri 2a str. 2457T
gagaauguagaugccgcauugcuggaaaaaaugccgaaacugcgugccacaucaacgaucuc

SEQ ID NO: 4248827 - RNA, 71 nt, Shigella flexneri 2a str. 2457T
cacugcgcugcgucuggcauuaggaacgcugauccucaucgcguucuuuaagccauggcgacugcgcuuug

SEQ ID NO: 4248828 - RNA, 68 nt, Shigella flexneri 2a str. 2457T
acggcuuagcaucuuuuguucagcuggggcuucaauaucaccgguuagaagaaugcuauucgucccgu

SEQ ID NO: 4248829 - RNA, 60 nt, Shigella flexneri 2a str. 2457T
acgucagcgcuggcuguuuuacgcguaugacaggauacggaggacgguuguggcgcacgu

SEQ ID NO: 4248830 - RNA, 62 nt, Shigella flexneri 2a str. 2457T
gcgauacaacuggucgaauaauccugggucgauggacuuuauuuuguucgcgcgguaaucgc

SEQ ID NO: 4248831 - RNA, 83 nt, Shigella flexneri 2a str. 2457T
caaugccggauacgugguuuuaaaagaucuuaaugguccacugcaauaucuguugaugccaacguaucguauuaacgguacug

SEQ ID NO: 4248832 - RNA, 87 nt, Shigella flexneri 2a str. 2457T
caggacaugauugaguauaucgacguuggugcgacguauuucuucaacaaaaauaugucgaccuauguugauuauaaaaucaaccug

SEQ ID NO: 4248833 - RNA, 80 nt, Shigella flexneri 2a str. 2457T
cgggcagugaugugauugucugcgcugaaauggacgaacauuggggcuacgucggugcuaaaucacgucagcgcuggcug

SEQ ID NO: 4248834 - RNA, 65 nt, Shigella flexneri 2a str. 2457T
cgauagccaucaucaauucaaacugaguaucaucgacggaugcgcggauauugguggugcgaucg

SEQ ID NO: 4248835 - RNA, 62 nt, Shigella flexneri 2a str. 2457T
ggcaaguuuauucaucgccgggagcuuacugaaguaagugaccgggguggagaaacgcagcc

SEQ ID NO: 4248836 - RNA, 80 nt, Shigella flexneri 2a str. 2457T
aacugccugaccgaagcgcugggccugucgcagccgggcaacggcucgcugcuggcaacccacgcggaccguaagcaguu

SEQ ID NO: 4248837 - RNA, 61 nt, Shigella flexneri 2a str. 2457T
gaugugauugucugcgcugaaauggacgaacauuggggcuacgucggugcuaaaucacguc

SEQ ID NO: 4248838 - RNA, 84 nt, Shigella flexneri 2a str. 2457T
gcugauauagugccagaacuggugauacagcggcugauccaaccccagcugcugacgcaccaguucuauaaccugcgcaucagc

SEQ ID NO: 4248839 - RNA, 99 nt, Shigella flexneri 2a str. 2457T
gcgcauacaaccgggcagugaugugauugucugcgcugaaauggacgaacauuggggcuacgucggugcuaaaucacgucagcgcuggcuguuuuacgc

SEQ ID NO: 4248840 - RNA, 56 nt, Shigella flexneri 2a str. 2457T; identical to SEQ ID NO: 4227417

SEQ ID NO: 4248841 - RNA, 61 nt, Shigella flexneri 2a str. 2457T
gcuucgucauuccgaaaggcuaccuguacgcugccauugguuucucggugaugaucgaggc

SEQ ID NO: 4248842 - RNA, 87 nt, Shigella flexneri 2a str. 2457T
aucgccuuucagguagaugaaagagagauucggauuaccuucacgcagcaagucgcgauagugcuuuuucagugcagaacaggcgau

SEQ ID NO: 4248843 - RNA, 86 nt, Shigella flexneri 2a str. 2457T
cauccacauucaggaacuggcgugugugucccgugacaccaagcuggguccggaagagaucaccgcugacaucccgaacgugggug

SEQ ID NO: 4248844 - RNA, 77 nt, Shigella flexneri 2a str. 2457T
cgaucugcucgaacagaauggccguggucguguucuugucgucgauggcggugguucuguucgucgcgcacuggucg

SEQ ID NO: 4248845 - RNA, 58 nt, Shigella flexneri 2a str. 2457T
gcgucuuaucuggccuacgaagggcuaacgugcagguuuuguaggucggauaaggcgu

SEQ ID NO: 4248846 - RNA, 55 nt, Shigella flexneri 2a str. 2457T
gcgaacuuacgucugguuauuucuaucgccaagaaauacaccaaccguggcuugc

SEQ ID NO: 4248847 - RNA, 75 nt, Shigella flexneri 2a str. 2457T; identical to SEQ ID NO: 4228306

SEQ ID NO: 4248848 - RNA, 77 nt, Shigella flexneri 2a str. 2457T; identical to SEQ ID NO: 4227869

SEQ ID NO: 4248849 - RNA, 79 nt, Shigella flexneri 2a str. 2457T; identical to SEQ ID NO: 4228569

SEQ ID NO: 4248850 - RNA, 77 nt, Shigella flexneri 2a str. 2457T
gcguuccugcagacguugauugaacagcugaacuaacaugcuccauucagcuuguucgacaaagcuuugcucaucgu

SEQ ID NO: 4248851 - RNA, 73 nt, Shigella flexneri 2a str. 2457T
ugucacuuucgcuuugauggcugcggcauucgggcgcucgcgacgcggcagcaccgucaggccaaaagugaua

SEQ ID NO: 4248852 - RNA, 70 nt, Shigella flexneri 2a str. 2457T
gcguuaccggcuucgagaggcagcuguccauaccggacuccagacaccgcugcuucucuucagccaacgc

SEQ ID NO: 4248853 - RNA, 55 nt, Shigella flexneri 2a str. 2457T
gguaguucuucacugaaauuugccaucaucgaugcaguaaauggugaagaguacc

SEQ ID NO: 4248854 - RNA, 63 nt, Shigella flexneri 2a str. 2457T
acaaaacggagacacaccaagcuuugcacuggauugcaaggcuuugugcucuucugugaaugu

SEQ ID NO: 4248855 - RNA, 73 nt, Shigella flexneri 2a str. 2457T
ugcguugaccgauaguuaagucaaaaccgacgccaaaagcgucgguuuuuucauggcuauacuuagcgaugca

SEQ ID NO: 4248856 - RNA, 82 nt, Shigella flexneri 2a str. 2457T
uccugacugguauagguauggagcuuauaaggguugcccgcaaacuuucugaauaaacucucaauaccgauacuacucauga

SEQ ID NO: 4248857 - RNA, 87 nt, Shigella flexneri 2a str. 2457T
gcuggcguuugagacgugcaaucucgguagacaucuccaguucacguucagaagacgucugcugauuuugcuguuuacugcgccagu

SEQ ID NO: 4248858 - RNA, 101 nt, Shigella flexneri 2a str. 2457T
ugccggaugcgucgugaacgccuuauccggccuacaaacgcacgaagauucaacauguugcaauagauuuuguaggccugaugagcguagcgcaucaggca

SEQ ID NO: 4248859 - RNA, 63 nt, Shigella flexneri 2a str. 2457T
ccaagaucaugaaaaaacuguccggugguauccguaccgcucuggcacaguaucgugaacugg

SEQ ID NO: 4248860 - RNA, 68 nt, Shigella flexneri 2a str. 2457T; identical to SEQ ID NO: 4228091

SEQ ID NO: 4248861 - RNA, 95 nt, Shigella flexneri 2a str. 2457T
gacggauugcggaaccgguuaugucuacgaugugauugccgauuuugacggcaagccuuccauuacgcugaccgaauuugcugaacaaugccguu

SEQ ID NO: 4248862 - RNA, 77 nt, Shigella flexneri 2a str. 2457T
uacucaggccugcguugguguaguuguucacaacgaugugguucauguuggcaaucugcugcgccgucaggucagua

SEQ ID NO: 4248863 - RNA, 117 nt, Shigella flexneri 2a str. 2457T
aaagccggguuuuacgucaaucgcaucuuagcgccuuacauuaaugaagcuauccgcaugcugaccgaaggugaacggguagagcacauugaugccgcgcuagugaaauuugguuuu

SEQ ID NO: 4248864 - RNA, 98 nt, Shigella flexneri 2a str. 2457T
gccugaugcgcuacgcuuaucaggccuacgcaguaccuguaauauauugaaucugcaggacuuuguaggccggauaaggcguuaacgccgcaucaggc

SEQ ID NO: 4248865 - RNA, 61 nt, Shigella flexneri 2a str. 2457T
gugcagauaggcuaacaauuaccggauggcgagugccauccgguaucguggcuuauucaac

SEQ ID NO: 4248866 - RNA, 55 nt, Shigella flexneri 2a str. 2457T
ccggugcugaugggcguggcgaaaccgguucacguguuaacgccgaucgcaucgg

SEQ ID NO: 4248867 - RNA, 72 nt, Shigella flexneri 2a str. 2457T
accguuuuccgugaguaucucggcgaacuguucagccgugguuauuccgucgaguacuucguggaaggcggu

SEQ ID NO: 4248868 - RNA, 56 nt, Shigella flexneri 2a str. 2457T
uaacggcagugaagauucguggcauaaguuuugcucauugaauuuuccugccguug

SEQ ID NO: 4248869 - RNA, 79 nt, Shigella flexneri 2a str. 2457T
gagcaaagauagaagcacggcugagagcaccaccagagaacauguuaaacaucucaaugauggugccucgcuguugcuc

SEQ ID NO: 4248870 - RNA, 70 nt, Shigella flexneri 2a str. 2457T
cgacaaaggcguugcagugcauggaugucgagaaagugcagcggcaucggcuacagcagcagccuguuug

SEQ ID NO: 4248871 - RNA, 130 nt, Shigella flexneri 2a str. 2457T
cccaaccugaaucucgacaacuccguccacaucacuaaccuggucuuuuccaucuugcguaacgcucgcgcgcugcaugugggugaagcgccaaauaugguggucugcuggggcggucacucaauuaacg

SEQ ID NO: 4248872 - RNA, 77 nt, Shigella flexneri 2a str. 2457T
gccaagaauuuauuucugguuauugcaacaaugaaugucuguuaauaaaguuaaauaauccaguuauaguuuuuggu

SEQ ID NO: 4248873 - RNA, 70 nt, Shigella flexneri 2a str. 2457T
gauaugcaaaaagccucaguuucuaugcaaauggggauucaggugcguaauaagcugguggcggcguauc

SEQ ID NO: 4248874 - RNA, 129 nt, Shigella flexneri 2a str. 2457T
aguuaugcaaauagucauguuugacaggcagucaauauuuauucauggaauaaaaaucaguuuacagcagcguauuccaggagugaguauucagggggucagucaggcagacgaguuauggcaaaagcu

SEQ ID NO: 4248875 - RNA, 121 nt, Shigella flexneri 2a str. 2457T
cgcugggcgcuggcgcuggaagauggcaaauugcuggcugccgucaaccagacgcuggugaguuuugaccauccgcugacugacggcgacgaaguagcuuucuucccgccgguaaccggag

SEQ ID NO: 4248876 - RNA, 67 nt, Shigella flexneri 2a str. 2457T
guuuaugaaggccagccggucaucagcgacaaagguguuguuggucaggugguggccgucgcuaaac

SEQ ID NO: 4248877 - RNA, 73 nt, Shigella flexneri 2a str. 2457T
gugaggaacauaauuacgugaucgccuugcucaaugcgcagauugucauuggcaaucaucacgucguuuccac

SEQ ID NO: 4248878 - RNA, 92 nt, Shigella flexneri 2a str. 2457T
auuuccgcgaucgcuuaggcguaggccgaaagcuggcaauucagauucuggaauauuuugaccgcauuggcuuuacgcgucgucguggaaau

SEQ ID NO: 4248879 - RNA, 64 nt, Shigella flexneri 2a str. 2457T; identical to SEQ ID NO: 4228045

SEQ ID NO: 4248880 - RNA, 68 nt, Shigella flexneri 2a str. 2457T
gcuggacgaguaagugugaaguugccggauguguugcauccggcauggcauuuuuauuugugguuggc

SEQ ID NO: 4248881 - RNA, 93 nt, Shigella flexneri 2a str. 2457T
cgccaacguucugcggcaauuucacacaccaguugcucaacggcgcuuaagccaucgacgguggugucauuguccagaagguagaacguugcg

SEQ ID NO: 4248882 - RNA, 59 nt, Shigella flexneri 2a str. 2457T
gcgauuauucaccccacguuugcguaauucaugcgcaaagggcaacaggugauaaucgu

SEQ ID NO: 4248883 - RNA, 76 nt, Shigella flexneri 2a str. 2457T
agccgccauugccuggcugcaggaacaccauguaaaaguagagguacuggguuaugucugagccgaugauguggcu

SEQ ID NO: 4248884 - RNA, 97 nt, Shigella flexneri 2a str. 2457T
guggucaguguugcguccaggcggaguguugucguuaauguucuacaaugcgcaugguuuguugaugcauaacauggucgccgggaauuuugauuac

SEQ ID NO: 4248885 - RNA, 68 nt, Shigella flexneri 2a str. 2457T
ugccggaugcguuucgcuuaucugaccuggcaucgcguguaggccggauaagcgaagcgcauccggca

SEQ ID NO: 4248886 - RNA, 69 nt, Shigella flexneri 2a str. 2457T
uguuuuuacugauguugcgaaaacgcuucgauacuacgcgaaucgcaaucgaaacaaucggugccagca

SEQ ID NO: 4248887 - RNA, 61 nt, Shigella flexneri 2a str. 2457T
aggggauuaacgucugggaacugauucgccuggcgaaucgucacccucgcguuaauauucu

SEQ ID NO: 4248888 - RNA, 76 nt, Shigella flexneri 2a str. 2457T
ggcgguacgcagguuugcaaaaaugguacgcaaaaaaggaaagugcguaccagcagaaagccugccauuacuggcc

SEQ ID NO: 4248889 - RNA, 63 nt, Shigella flexneri 2a str. 2457T
gcagcacuuuuugcugauugccaccggagagaaauucaaucgguuguucaguugaaggugugc

SEQ ID NO: 4248890 - RNA, 80 nt, Shigella flexneri 2a str. 2457T
cagggcagcagugcugccgaauccguuuuauccucaucguugucgaagauaaucccugauucgcagucaauauuguccug

SEQ ID NO: 4248891 - RNA, 70 nt, Shigella flexneri 2a str. 2457T
cauaauauugucgaaauguguuuauaaaguacgacguacugcuauagccacauuuuuccgcaauaguaug

SEQ ID NO: 4248892 - RNA, 91 nt, Shigella flexneri 2a str. 2457T
guucacguuggcaccggaaagaauaugcgccagccguucgccgcgaauguugugcugggcgauauauuuuuucauucccgccagcgccagc

SEQ ID NO: 4248893 - RNA, 72 nt, Shigella flexneri 2a str. 2457T
cguccggucgggcaggugugcucaaaugcauccagaccuucgugauaccagcgcaccagcaccgacugagcg

SEQ ID NO: 4248894 - RNA, 86 nt, Shigella flexneri 2a str. 2457T
gcaccggauuucaccagcgccagcgcuucuggcagcgcaucgacgccaaacaccggaaugcuggacuuguugugugcuuucagugc

SEQ ID NO: 4248895 - RNA, 60 nt, Shigella flexneri 2a str. 2457T
aacugaaaggcugggccauguucuaucaguucguugauuuuaaggccaaagucuucaguu

SEQ ID NO: 4248896 - RNA, 68 nt, Shigella flexneri 2a str. 2457T
gagccggugacguuggugcguucacccacguucacaaacaggcuaucgucgccaauguucagcggcuc

SEQ ID NO: 4248897 - RNA, 72 nt, Shigella flexneri 2a str. 2457T
guugaugcuggcaagauggaagguacguuuaagcguaagccggagcguucugaucugucugcggacauuaac

SEQ ID NO: 4248898 - RNA, 82 nt, Shigella flexneri 2a str. 2457T
uuauuuucggucuggcgauguucuaugaaguggccuuuaucauguuagcgccgcugguuauuguuauugccgccgaagcuaa

SEQ ID NO: 4248899 - RNA, 92 nt, Shigella flexneri 2a str. 2457T
cggcgggcacgccauauuuugucgcacgggauauuccuugcgaaaugugugaggacauuccgugcgccaaagugugcccaagcggugcgcug

SEQ ID NO: 4248900 - RNA, 65 nt, Shigella flexneri 2a str. 2457T
cgcuguacuggauuggcccgccgggcgguaaaugugaugccgguccggggaccgauuuugcugcg

SEQ ID NO: 4248901 - RNA, 79 nt, Shigella flexneri 2a str. 2457T
gggaaaacgcagccuuaaaauaggccggaugcggcguaaacgccuuauccggcauacgauuuuauucggccuggcuccc

SEQ ID NO: 4248902 - RNA, 57 nt, Shigella flexneri 2a str. 2457T
cugguagguauaacguuggcgugagcaucuucacgccaacgugcuguuacuugccgg

SEQ ID NO: 4248903 - RNA, 68 nt, Shigella flexneri 2a str. 2457T
augcagcucgauaaacccuuuuucauccggcgucgaggccauugagaacggacguuugucgcgcucau

SEQ ID NO: 4248904 - RNA, 58 nt, Shigella flexneri 2a str. 2457T
agauuggugucaaucauguguugcaggaugcuggcauucaggugauugaaaccgaucu

SEQ ID NO: 4248905 - RNA, 63 nt, Shigella flexneri 2a str. 2457T
auggaauaugccuucuggauggacggugcagaaucguugaucccuaaucaggccuaucgccau

SEQ ID NO: 4248906 - RNA, 77 nt, Shigella flexneri 2a str. 2457T
cgaguacauccaguucgauuucccgcggaucgacuucgaucgaaaucuccgcaucgguauugaaauggaaguuuucg

SEQ ID NO: 4248907 - RNA, 80 nt, Shigella flexneri 2a str. 2457T
gcaaagaauacgaggucaacggagcggacaaccugcuggaagcuugucugucucugggccuugauauuccuuacuuuugc

SEQ ID NO: 4248908 - RNA, 64 nt, Shigella flexneri 2a str. 2457T
uuccgucgcacuggguguggcuucagccuugccacuguggagccgugcagucuuugcggcggaa

SEQ ID NO: 4248909 - RNA, 58 nt, Shigella flexneri 2a str. 2457T
guugagcaugaacccgguugagcgccgugugcagcgccuacuguuaggucaugccagc

SEQ ID NO: 4248910 - RNA, 63 nt, Shigella flexneri 2a str. 2457T
uccggaagacgaacuugccagcgaaccgugguacagcgucucgccgggcgauguuuucccgga

SEQ ID NO: 4248911 - RNA, 97 nt, Shigella flexneri 2a str. 2457T
ugccugaugcgacgcuugacgcgucuuaucaggccuacaacuccguugaaauugcugguuuuguaggcuggauaaggcguucacgccgcauccggca

SEQ ID NO: 4248912 - RNA, 69 nt, Shigella flexneri 2a str. 2457T
gccgaucauccgcagaagaaaaaguauggccgcguggaacuggucgguccguucuccgugcgugauggc

SEQ ID NO: 4248913 - RNA, 58 nt, Shigella flexneri 2a str. 2457T
ggcguuaggaucguauggugagaacccgcgcgguauuaccgacaaaaugaccagcgcc

SEQ ID NO: 4248914 - RNA, 55 nt, Shigella flexneri 2a str. 2457T
cucggcgcgcuggucgguaagggcgcugauccuaccgcuaucagcgucgccgcag

SEQ ID NO: 4248915 - RNA, 66 nt, Shigella flexneri 2a str. 2457T
gauugaagugaacguguaggccugauaagcguagcgcaucaggcaauguugcguuugucaucaguu

SEQ ID NO: 4248916 - RNA, 78 nt, Shigella flexneri 2a str. 2457T; identical to SEQ ID NO: 4227789

SEQ ID NO: 4248917 - RNA, 77 nt, Shigella flexneri 2a str. 2457T; identical to SEQ ID NO: 4228107

SEQ ID NO: 4248918 - RNA, 63 nt, Shigella flexneri 2a str. 2457T
ucaccguauucuggaaagcauggcgcagguaaaaacgcguaaaaacuuuucugauacggauga

SEQ ID NO: 4248919 - RNA, 60 nt, Shigella flexneri 2a str. 2457T
guaccugcguucacacccaacuucgcggcauccgcuggguugaguuugauguacggcugc

SEQ ID NO: 4248920 - RNA, 63 nt, Shigella flexneri 2a str. 2457T
cuacgcaucuuucauuuauaaaggcccuacuaagagccgcagagcgugaauggaaaaugcugg

SEQ ID NO: 4248921 - RNA, 73 nt, Shigella flexneri 2a str. 2457T
ggauaaucguucauugcuauucuaccuaucgccaugaacuaucguggcgauggaggauggauaaugaauauuc

SEQ ID NO: 4248922 - RNA, 71 nt, Shigella flexneri 2a str. 2457T
acgcaguuccgggcuauuuuucaccgaguucagguggcugaccggggagaagauacgccccaaaacaucgu

SEQ ID NO: 4248923 - RNA, 84 nt, Shigella flexneri 2a str. 2457T
gaccgccagauaagagugcauucccagcucuuucaucugcuguucgccgauaacgcgggugaugacauucuugcuguagcuguc

SEQ ID NO: 4248924 - RNA, 89 nt, Shigella flexneri 2a str. 2457T
gagcuaccuuucaccuucagaucuuuaaugaugguaacgcugucgccgucagccagcagauugccguuagcaucuuuaacgaucagcuc

SEQ ID NO: 4248925 - RNA, 68 nt, Shigella flexneri 2a str. 2457T
aacgagaucugcggcuugucgugcggugauugauucguuuuuugccagauagucgaggaucugccguu

SEQ ID NO: 4248926 - RNA, 57 nt, Shigella flexneri 2a str. 2457T
uugggucaauuugucugcuugcugaacaggaacuccgggaaagcggcgaugacuuaa

SEQ ID NO: 4248927 - RNA, 77 nt, Shigella flexneri 2a str. 2457T
guaggacggauaagacguuuacacugcauccggcaaccuaugccugaugcgacgcggaagcgucuuaucaugccuac

SEQ ID NO: 4248928 - RNA, 76 nt, Shigella flexneri 2a str. 2457T; identical to SEQ ID NO: 4227814

SEQ ID NO: 4248929 - RNA, 72 nt, Shigella flexneri 2a str. 2457T
guccaccugggugccgacacugcgugggucaguugcggcuuugguacccacagcagcgguacccacuacggc

SEQ ID NO: 4248930 - RNA, 63 nt, Shigella flexneri 2a str. 2457T
uuuaucggguacuaaaguucugcaccaucagcgauggauuuauucgauguuagacucgauaaa

SEQ ID NO: 4248931 - RNA, 65 nt, Shigella flexneri 2a str. 2457T
augccgacagaucguuaaccugcacacucccuugcugucgcagacgcugaaugaucuguucucgu

SEQ ID NO: 4248932 - RNA, 73 nt, Shigella flexneri 2a str. 2457T
uguuuauacgcacucaauugcucuggagacauuuuaucgagaacgucuugcgauugauguggcacguuagaca

SEQ ID NO: 4248933 - RNA, 59 nt, Shigella flexneri 2a str. 2457T
ccagaucggaaccacggacgauaucgccgccagcaaagauuuucggguugcuggucugg

SEQ ID NO: 4248934 - RNA, 81 nt, Shigella flexneri 2a str. 2457T
uuagcgucgcucuuauccaucugcuugcuguuggcgucccauaugacgugugagcaggcuucauggauuggcaggcgucgg

SEQ ID NO: 4248935 - RNA, 64 nt, Shigella flexneri 2a str. 2457T
ugcgugucuugccggucuggaccagcgauccgcaaucgcugugccagcagagcgagaugcagca

SEQ ID NO: 4248936 - RNA, 69 nt, Shigella flexneri 2a str. 2457T
gaaaugaccagcguuaccgguacgccauuuuuguucauuuuagcgaaugccgcuggcagcagguuuuuc

SEQ ID NO: 4248937 - RNA, 87 nt, Shigella flexneri 2a str. 2457T
ggguaaacguggcgguguggcgguugcacugucucuugccgcggucacgucacucccggugcuggcugcugacaucguugugcaccc

SEQ ID NO: 4248938 - RNA, 90 nt, Shigella flexneri 2a str. 2457T
auaguccuauugauguguauucuugcaguugcugagcaucaaaggcauccaacuguccauuaagaagacgcuuauuaaauuccaggcuau

SEQ ID NO: 4248939 - RNA, 85 nt, Shigella flexneri 2a str. 2457T
cguggugucagcggcggacaaggauaagcacgcgucagcaguuccgccaacacugcgacagcguuguccucgcggcuuuuacccg

SEQ ID NO: 4248940 - RNA, 58 nt, Shigella flexneri 2a str. 2457T
uccggaugauuaauguuggccgggauaaucgcacguccggcagcaacuucaucacgga

SEQ ID NO: 4248941 - RNA, 81 nt, Shigella flexneri 2a str. 2457T
gcccggcguugugguguucgcguugagcguuucucaauaggguuugguaaggcgcucuggcggcgaacugauaagcucggc

SEQ ID NO: 4248942 - RNA, 65 nt, Shigella flexneri 2a str. 2457T
ggcggaaauacucgccacggaacgggcagauaauaaagcccgguucgaggccgagcauuuucacc

SEQ ID NO: 4248943 - RNA, 64 nt, Shigella flexneri 2a str. 2457T
uugaaaccucuauuacgucaacccuuccgcacucgggaggguucuacuguuauagggauuuuag

SEQ ID NO: 4248944 - RNA, 57 nt, Shigella flexneri 2a str. 2457T
aucggcuuuacuaacgucgauagucaagggauugagggcguugagaagaguuucgau

SEQ ID NO: 4248945 - RNA, 83 nt, Shigella flexneri 2a str. 2457T
gugcggcaucugcuucagaagcugaaccguugaugauaguguucaucagcguguaccagucuuuuucgaugcgaugcauguac

SEQ ID NO: 4248946 - RNA, 74 nt, Shigella flexneri 2a str. 2457T
cgccuguauggaugcuugucgggaagugaacaaggugccggaaggcgucucgcgccugacgauuauucguagcg

SEQ ID NO: 4248947 - RNA, 81 nt, Shigella flexneri 2a str. 2457T
cuuuccagaaggauuuuuucaaaucccacuacgaaggccgaagucuucacaguauauuugaaaaaggacucuaagggaaag

SEQ ID NO: 4248948 - RNA, 56 nt, Shigella flexneri 2a str. 2457T
gccagacaacagggagaguagaugggcgcuuaccugauucgccgucuguugcuggu

SEQ ID NO: 4248949 - RNA, 67 nt, Shigella flexneri 2a str. 2457T
uugcgcgaagcgagguugcugcggaaauagcuggaaagccguuuuuucaggucuuucgcuuugccga

SEQ ID NO: 4248950 - RNA, 79 nt, Shigella flexneri 2a str. 2457T
uuguugcuggcaacggcguuuacccugagccagcuguuccauaacgguuuucagauugugcgucgugagugaguaguag

SEQ ID NO: 4248951 - RNA, 67 nt, Shigella flexneri 2a str. 2457T
gagcguuuuggcauacagaaaacgauaugacugaccuuuauguucgcuuuggucugccagcguacuc

SEQ ID NO: 4248952 - RNA, 63 nt, Shigella flexneri 2a str. 2457T
guucucucgauccgcaggaauacgaagaugacgccguauuccguagcuauaucgacgacgaau

SEQ ID NO: 4248953 - RNA, 55 nt, Shigella flexneri 2a str. 2457T
cagccgguaagccugcuuuucaucuucacaggcgaugaguacgcgcuuaccgcug

SEQ ID NO: 4248954 - RNA, 107 nt, Shigella flexneri 2a str. 2457T
gccagugugacccgcagcaaacaacacaaauuauuacagacugcccgcuuguggcucgcgcgucauaaugggaguuuugauacuguggauugccgguucgauguggu

SEQ ID NO: 4248955 - RNA, 75 nt, Shigella flexneri 2a str. 2457T
gaucgccggaacaaucgugaauagcgcaauaaugaugcuaaucguggcgcuguucugcgcuuuuucugccgcauc

SEQ ID NO: 4248956 - RNA, 92 nt, Shigella flexneri 2a str. 2457T
gcaggcuggaggagaccaugaguuuaucuuguuauggauuguguuaucacaauuccaauaagaagaacuuuaaguccagccuccacucccgc

SEQ ID NO: 4248957 - RNA, 129 nt, Shigella flexneri 2a str. 2457T
aaugacugcccugaucgcuguggaacaucaccccgccgggcuuaccacggguuucccaugccauuuccagcgcuuucauggugagccugcugguaagcgccccgagaaguacguagcguaaggauuauu

SEQ ID NO: 4248958 - RNA, 98 nt, Shigella flexneri 2a str. 2457T
gccugaugcgcuacgcuuaucaggccuacgugguuuaugcaauauauugaauuugcauggucuuguaggccagauaagacguucacgucgcauccggc

SEQ ID NO: 4248959 - RNA, 60 nt, Shigella flexneri 2a str. 2457T; identical to SEQ ID NO: 4227980

SEQ ID NO: 4248960 - RNA, 60 nt, Shigella flexneri 2a str. 2457T
caggugcaacucaggcaucauggcgacuggcgggugugccggaugucuggagcuggcuug

SEQ ID NO: 4248961 - RNA, 109 nt, Shigella flexneri 2a str. 2457T
ugccacguuuucugucgccguaaugcuugcucugguuguaugcguagucuggcaaguauuuagccgcuacguacuuaaccagccaaguacauuaaccgaugagcuggca

SEQ ID NO: 4248962 - RNA, 55 nt, Shigella flexneri 2a str. 2457T
uccggccuacaaaaucgugcaaauucaauacauugcagaauuuucguaggccuga

SEQ ID NO: 4248963 - RNA, 76 nt, Shigella flexneri 2a str. 2457T; identical to SEQ ID NO: 4228014

SEQ ID NO: 4248964 - RNA, 70 nt, Shigella flexneri 2a str. 2457T
cauaauucagggucuggauugccugcaauacgcggucacgcguugcaggacgcacagauucugcauuaug

SEQ ID NO: 4248965 - RNA, 76 nt, Shigella flexneri 2a str. 2457T; identical to SEQ ID NO: 4227382

SEQ ID NO: 4248966 - RNA, 73 nt, Shigella flexneri 2a str. 2457T
caccgcugguagcugaaauggcaucgcgugcggcaacgaucgcauaagaagcuuucauuucagccagcgagug

SEQ ID NO: 4248967 - RNA, 85 nt, Shigella flexneri 2a str. 2457T
ucguucuaucuucuuugguuugcugauuacgccgugggcggucuacuuucuaucgguggucgucgagcaacuggaggagucacga

SEQ ID NO: 4248968 - RNA, 70 nt, Shigella flexneri 2a str. 2457T
ugcccuugcucauauaaauaauuuacugcaucaaaugcggcggucagauugucgauaugaacgguaggca

SEQ ID NO: 4248969 - RNA, 61 nt, Shigella flexneri 2a str. 2457T
gcguacaccaucaacauugaaaaaauacucguacagguugccuuucaggauaggugugcgc

SEQ ID NO: 4248970 - RNA, 83 nt, Shigella flexneri 2a str. 2457T
agugauugcauauaagauugugaaugacggccggaauagaucauguccugccacuguuucaccauccccagauagcgguuauu

SEQ ID NO: 4248971 - RNA, 71 nt, Shigella flexneri 2a str. 2457T
acccaggcccguaauaucacccgguucgggaccaucgaaucggucacuuaugauauugccgaggggucggu

SEQ ID NO: 4248972 - RNA, 62 nt, Shigella flexneri 2a str. 2457T
ggaaguccccgucaccaucgcaaccacgcugccgauaaaacagauggugaugaucgauuucc

SEQ ID NO: 4248973 - RNA, 69 nt, Shigella flexneri 2a str. 2457T; identical to SEQ ID NO: 4227933

SEQ ID NO: 4248974 - RNA, 91 nt, Shigella flexneri 2a str. 2457T
uguccugaauuuucggauggguggcgaugauauuuuccagcuccacgcaggagacauucucgccaccgcguuugaucauauugcagcggcg

SEQ ID NO: 4248975 - RNA, 65 nt, Shigella flexneri 2a str. 2457T
cuguaaucaacacagugaugaaaacgaaggccggagcaugcuccggccuuuuuuaucucuuacag

SEQ ID NO: 4248976 - RNA, 68 nt, Shigella flexneri 2a str. 2457T
gcuaaaaucccuauaacaguagaacccucccgagugcggaaggguugacguaauagagguuucaaagu

SEQ ID NO: 4248977 - RNA, 61 nt, Shigella flexneri 2a str. 2457T
ccgaaaauggcggcaaucuggcuuuucauaaagguggagaucagcagccccauuccagugg

SEQ ID NO: 4248978 - RNA, 64 nt, Shigella flexneri 2a str. 2457T
ggauugagccucagauuaauguuaagcgucuugcaggacgcguaauguuaacuggggcuuuucu

SEQ ID NO: 4248979 - RNA, 60 nt, Shigella flexneri 2a str. 2457T
gacuggccgacaacgcuugcuggucgcauuuauuccuacguaagcauuaucggccauuuc

SEQ ID NO: 4248980 - RNA, 74 nt, Shigella flexneri 2a str. 2457T
cgaguccgucucugaagggcauccugacaaaauugcugaccaaaucucugaugccguuuuagacgcgauccucg

SEQ ID NO: 4248981 - RNA, 58 nt, Shigella flexneri 2a str. 2457T
ggcaaagcauuacuggucauugcagaacguauucugaaugaagccaguaauguucguc

SEQ ID NO: 4248982 - RNA, 85 nt, Shigella flexneri 2a str. 2457T
caauauucucgcccuuagcucugcuacgucgcauggauuucgucaaaguacccgcgugcuggcagggaugagucugggauuuuug

SEQ ID NO: 4248983 - RNA, 91 nt, Shigella flexneri 2a str. 2457T
gugguacagcgcggcaaugaaaucagcuauuuugaaccgggacuugaaccguucacgcuuaauggcgauuacauuguugauucucugccau

SEQ ID NO: 4248984 - RNA, 73 nt, Shigella flexneri 2a str. 2457T
aauagaauuauauacucuagauaauucaagucgcagcacaugcaacuugaaguaugacgaguauagcuuuauu

SEQ ID NO: 4248985 - RNA, 68 nt, Shigella flexneri 2a str. 2457T
cguaugguugaguuugaguggcuggaagacacgaguuugcaucgccugcucaaaacucaaaccagacg

SEQ ID NO: 4248986 - RNA, 97 nt, Shigella flexneri 2a str. 2457T
ccaugccggcgugugccagcucuuucagguggaaggauagcgaagacggcgggaugccggccgcuucgcugauuuuuccggcggccaugccggcggg

SEQ ID NO: 4248987 - RNA, 63 nt, Shigella flexneri 2a str. 2457T; identical to SEQ ID NO: 4245936

SEQ ID NO: 4248988 - RNA, 58 nt, Shigella flexneri 2a str. 2457T
guuccguguuugcgaucaaacgccgggcgcagcuuugcguaaucggcaagcgaggaau

SEQ ID NO: 4248989 - RNA, 71 nt, Shigella flexneri 2a str. 2457T; identical to SEQ ID NO: 4227345

SEQ ID NO: 4248990 - RNA, 97 nt, Shigella flexneri 2a str. 2457T
ccguugcuguuggcguugggggccggggcguuaauugcgcuguugcguacgccgauuaucgaucuggcgcugcauauuguuggcgguagugaagcgg

SEQ ID NO: 4248991 - RNA, 81 nt, Shigella flexneri 2a str. 2457T
auucgucccugauauagcacaugaacguaaucaggcuugauguagucgagaaugcguugguagugcguaacaaugaugaau

SEQ ID NO: 4248992 - RNA, 72 nt, Shigella flexneri 2a str. 2457T
gcgucuuaucaggccuacgaagugaauugcaauuuauugaauuaucacauauuuguaggccggauaaggcgu

SEQ ID NO: 4248993 - RNA, 57 nt, Shigella flexneri 2a str. 2457T
uacgcuuguugaguggugccgagacguuugucgaacggugccaguucgcgcagggua

SEQ ID NO: 4248994 - RNA, 71 nt, Shigella flexneri 2a str. 2457T
uaaccuagucauucacaccgaccugaacugccuuuccgugguucaguaugcaguggauguacucgaaguug

SEQ ID NO: 4248995 - RNA, 107 nt, Shigella flexneri 2a str. 2457T
gaaaacucuacuuuucagguaauuuauucccauaaacucagauuuacugcugcuucacgcaggaucugaguuuaugggaaugcucaaccuggaagccggagguuuuc

SEQ ID NO: 4248996 - RNA, 56 nt, Shigella flexneri 2a str. 2457T
gguaggaggaagagauggaaacuauugcuaaacaucgccaugcucguucuucugcu

SEQ ID NO: 4248997 - RNA, 82 nt, Shigella flexneri 2a str. 2457T
gccccucaagugucaaugaacacaagaaauuugccuccccucccgucauaccacuaaggcgacguauugauacuugaggggc

SEQ ID NO: 4248998 - RNA, 63 nt, Shigella flexneri 2a str. 2457T
ccagcgacgcgccagcaggaaagauccaguucagcgagaucuuuuucauucacgcggcguugg

SEQ ID NO: 4248999 - RNA, 63 nt, Shigella flexneri 2a str. 2457T
cagagcugccgugucaccacuguucagcgcaucgcgcagcagugccaguucauggcauuuuug

SEQ ID NO: 4249000 - RNA, 99 nt, Shigella flexneri 2a str. 2457T
cgccgauuggcucgaaucagggacuggaaacccgugccaugcuggagauuauuauccagcaggccacaguuccggugguugucgaugcuggcaucggcg

SEQ ID NO: 4249001 - RNA, 115 nt, Shigella flexneri 2a str. 2457T
ucgauuugaucaucaccaagcaaauugauggcauguugcugcuggguucaaggcugccguuugaugccagcauugaggaacagcguaaucugccgccgauggugauggcgaacga

SEQ ID NO: 4249002 - RNA, 104 nt, Shigella flexneri 2a str. 2457T
guucugccagcuggcguuugagacgugcaaucucgguagacaucuccaguucacguucagaagacgucugcugauuuugcuguuuacugcgccaguuguagagc

SEQ ID NO: 4249003 - RNA, 65 nt, Shigella flexneri 2a str. 2457T
ggcgcuugccugcuccccucacccuaacccucuccccaaaggggcgaggggaccguccgagcguu

SEQ ID NO: 4249004 - RNA, 88 nt, Shigella flexneri 2a str. 2457T
agcgcaaguggacucuauggcuggcaauacuggcagcagucgcaacggcuuuggcaaaccgccagcuaggcgcgggacuauuugcucu

SEQ ID NO: 4249005 - RNA, 91 nt, Shigella flexneri 2a str. 2457T
ccggcguugaaacguuuguugauaauaagauugggaucaucaaguuucacgaucuccagcuuacgguuaccagacucuguuucgaugaugg

SEQ ID NO: 4249006 - RNA, 62 nt, Shigella flexneri 2a str. 2457T
gugcggaugagaucgugaaacucagccaccagucuggcuaaaucgcgaauuucauuuggcac

SEQ ID NO: 4249007 - RNA, 130 nt, Shigella flexneri 2a str. 2457T
guaaaagcgggcguaccaacugcugugaaaaaauuucagucauuggcgugcaucaggauggcgguuuuagugaguauuugagcgugccgguggcgaacauuuugcccgcagacgguauugacccgcaggc

SEQ ID NO: 4249008 - RNA, 65 nt, Shigella flexneri 2a str. 2457T
cgucgauggcaaucgcaucuaucuggucgaucaaaaugaccgggugauggcguugaccauugaug

SEQ ID NO: 4249009 - RNA, 80 nt, Shigella flexneri 2a str. 2457T
gggcugguaagucuuaugaugcuauacugugcaauauugaaagaguguauaaaaaauggcgucaagaauaaauaucgcuc

SEQ ID NO: 4249010 - RNA, 55 nt, Shigella flexneri 2a str. 2457T
gcgcacuugaaucgcgggauugcauuauauuacggcggucgugacaaguuagcgc

SEQ ID NO: 4249011 - RNA, 86 nt, Shigella flexneri 2a str. 2457T
gaaccaugaaaucaaaaaucaaaucgcuacuggucgcugguuauaaccacggcugguuaaguauuucguuugucgauuucugguuu

SEQ ID NO: 4249012 - RNA, 59 nt, Shigella flexneri 2a str. 2457T
uauauaugaacaggaggaauagcugcuuuuaaagaagauauuccggccuguucaauaug

SEQ ID NO: 4249013 - RNA, 79 nt, Shigella flexneri 2a str. 2457T
cgagauguucugcucuuuagccgcagccaggucugccggagucaggcucaguacgcagcugaagacgaagaacauuacg

SEQ ID NO: 4249014 - RNA, 55 nt, Shigella flexneri 2a str. 2457T
uccacgaaauuccguaucagguaaacaaagcgcgccugaucgagaagauugcgga

SEQ ID NO: 4249015 - RNA, 65 nt, Shigella flexneri 2a str. 2457T
gaucguuaaagaugcuaacggcaaucugcuggcugacggcgacagcguuaccaucauuaaagauc

SEQ ID NO: 4249016 - RNA, 56 nt, Shigella flexneri 2a str. 2457T
caucgcuggaagguuggcgcauuucacaaccaguaaaauaccaauccccagcgaug

SEQ ID NO: 4249017 - RNA, 64 nt, Shigella flexneri 2a str. 2457T
ggccagucuacauaacucaucaugaaauugaucagcaauuuucauugaaaagugugaaccggcu

SEQ ID NO: 4249018 - RNA, 63 nt, Shigella flexneri 2a str. 2457T
ucaggcugagguugaucgcgcugugucugaaauaaacucuaaguugucaagcauucagcuuga

SEQ ID NO: 4249019 - RNA, 101 nt, Shigella flexneri 2a str. 2457T
cgcgcauacaaccgggcagugaugugauugucugcgcugaaauggacgaacauuggggcuacgucggugcuaaaucacgucagcgcuggcuguuuuacgcg

SEQ ID NO: 4249020 - RNA, 63 nt, Shigella flexneri 2a str. 2457T
cuuaucaggccuacacggagauugcaauauauugaauuugcaagauuuuguaggccugagaag

SEQ ID NO: 4249021 - RNA, 90 nt, Shigella flexneri 2a str. 2457T
gguucguugcaggcaauggaagcgaucaaacugcuggcagguuauggcaaaccggccagcgggaaaaucgucauguacgaugcgaugacc

SEQ ID NO: 4249022 - RNA, 70 nt, Shigella flexneri 2a str. 2457T
acuguucaagcgcgcuuaacgccguuuuguuaucucguagcaaaaggcgauuggugcguuuaucgacggu

SEQ ID NO: 4249023 - RNA, 90 nt, Shigella flexneri 2a str. 2457T
cagcggggcauuggccugaauaucuccacuggcgguaagcugaauauugccgucgccagucaacgguaauucaggccauccccauuguug

SEQ ID NO: 4249024 - RNA, 100 nt, Shigella flexneri 2a str. 2457T
ugccugaugcgcuacgcuuaucaggccuacgcguccccugcaauauuuugaauuugcacgauuuuguaggccggauaaggcgcucgugccgcauccggca

SEQ ID NO: 4249025 - RNA, 69 nt, Shigella flexneri 2a str. 2457T
guugagucaaucacgaugguggaaaucgaugcgggugucgugucguucugccgucaguaucugcccaac

SEQ ID NO: 4249026 - RNA, 77 nt, Shigella flexneri 2a str. 2457T
ccggcagugaugugauugucugcgcugaaauggacgaacauuggggcuacgucggugcuaaaucacgucagcgcugg

SEQ ID NO: 4249027 - RNA, 55 nt, Shigella flexneri 2a str. 2457T
gauugcgggugaaaaacugacggcgcucccuucccugucaggcuuccuugcgguc

SEQ ID NO: 4249028 - RNA, 66 nt, Shigella flexneri 2a str. 2457T
aaguuugccguggcaguggcgauggggacgaugaucuucacugucggcggugcgacggucgaauuu

SEQ ID NO: 4249029 - RNA, 80 nt, Shigella flexneri 2a str. 2457T
cgaccagcaguucgcgaauacgcugcucacggguuucaccuuuauggccuuccggcagcgcguuggugaagugcggguug

SEQ ID NO: 4249030 - RNA, 55 nt, Shigella flexneri 2a str. 2457T
aacgcgguaauaaguuugucggcgcagucuccaucgauucgcuuaaaaccgcguu

SEQ ID NO: 4249031 - RNA, 130 nt, Shigella flexneri 2a str. 2457T; identical to SEQ ID NO: 4227208

SEQ ID NO: 4249032 - RNA, 67 nt, Shigella flexneri 2a str. 2457T
cauuguggcgauuucugugcuuuuaucggcuaugugggcuggaaugauauaaaagaucgccucgaug

SEQ ID NO: 4249033 - RNA, 85 nt, Shigella flexneri 2a str. 2457T
uacugcugauauucucguuccgcgcaacacgcugcugcacgaacaguggugugaccugcuggaagagaacucugucgacgcggua

SEQ ID NO: 4249034 - RNA, 58 nt, Shigella flexneri 2a str. 2457T
agacggcaccugguccaccggcgguaauugccagcgcaacgccggccagguugccgcu

SEQ ID NO: 4249035 - RNA, 55 nt, Shigella flexneri 2a str. 2457T
gccgcagaaguggcgcuguuuaccuauaauagucgggcggcgcaaaucugguggc

SEQ ID NO: 4249036 - RNA, 80 nt, Shigella flexneri 2a str. 2457T
cgcugccaguucuucaagggucgguugugcaguugcauccuugcgggaugcaacugcacagccagaucaaguugccagcg

SEQ ID NO: 4249037 - RNA, 57 nt, Shigella flexneri 2a str. 2457T
ugcgacgaugacccaugacgaucugcauuucgucgaucgucugguguucgaucugca

SEQ ID NO: 4249038 - RNA, 55 nt, Shigella flexneri 2a str. 2457T
caagagauugcaggugcgguugcuacggcgaaaagacagcaccgugcagcucuug

SEQ ID NO: 4249039 - RNA, 72 nt, Shigella flexneri 2a str. 2457T
ggcaucuuuaccgacggugauuuacgccgugucuucgauaugggcguggauguucgucaguuaaguauugcc

SEQ ID NO: 4249040 - RNA, 83 nt, Shigella flexneri 2a str. 2457T
uugguggacgauauccaucugacuguuaguggccugggcgauaaacaccgccgccauugucagguauaucgaugugccaucaa

SEQ ID NO: 4249041 - RNA, 66 nt, Shigella flexneri 2a str. 2457T
ggcgagauaagcggcguuacagauauucggcggcauauuaccgagaucuuucgcugcuuuuauccc

SEQ ID NO: 4249042 - RNA, 59 nt, Shigella flexneri 2a str. 2457T
ucaacgaugaacuuuuuugccauugcgucacgucacgcaacugcuccauucguuguuga

SEQ ID NO: 4249043 - RNA, 62 nt, Shigella flexneri 2a str. 2457T; identical to SEQ ID NO: 4227177

SEQ ID NO: 4249044 - RNA, 129 nt, Shigella flexneri 2a str. 2457T
cggugaccaagcugaaucaacaugcgccccuggcgauggucggugaugguauuaacgacgcgccagcgaugaaagcugccgccaucgggauugcuauggguagcggcacagacguggcgcuggaaaccg

SEQ ID NO: 4249045 - RNA, 86 nt, Shigella flexneri 2a str. 2457T
gcaucgcgcgauuuuuccagagcuucagugaccggauguccgagguugaucagauaacugucguggggaagaauuugcgccgaugu

SEQ ID NO: 4249046 - RNA, 55 nt, Shigella flexneri 2a str. 2457T
gcugaccguugauauuguugccuagcgcauuggcaauaguugucagacguuuagc

SEQ ID NO: 4249047 - RNA, 68 nt, Shigella flexneri 2a str. 2457T
cccgcgccgccgugcugguggaggugaaucgcgauuacgucaccgccucucgcguggcaggugccggg

SEQ ID NO: 4249048 - RNA, 77 nt, Shigella flexneri 2a str. 2457T
gcgaagcacuguacgaugcguaucccgaucuugauccgaaaacgguucgauucaccgauaugcaucaguggauuugc

SEQ ID NO: 4249049 - RNA, 76 nt, Shigella flexneri 2a str. 2457T
guguucuggcugaccaccaguuugccauucaccaccgagguaaaccauugcaggucaauaucacgcacaugaauac

SEQ ID NO: 4249050 - RNA, 101 nt, Shigella flexneri 2a str. 2457T
augccggaugcggcguaaacgccuuauccggccuacaaauucugcaaauucaacaaauugcgaaucccuuguaggccugauaagcguagcgcaucaggcau

SEQ ID NO: 4249051 - RNA, 76 nt, Shigella flexneri 2a str. 2457T
uaucagucauuugcuggcuuuuacuugucaaccagaacgacaugaugaacaguuaacguuagcgaaugaagugaug

SEQ ID NO: 4249052 - RNA, 101 nt, Shigella flexneri 2a str. 2457T
ugccugaugcgcuucgcuuaucaggccuacagcaggcauugcaacugauugaaugcuugagaauuuguaggccggauaaggcguuuacgccgcauccggca

SEQ ID NO: 4249053 - RNA, 90 nt, Shigella flexneri 2a str. 2457T
uaaucccaggauuuauguuucagaucaucaucaucugaugccgguaacggcagcagcuggcugauggucggaaccugagacaugguguua

SEQ ID NO: 4249054 - RNA, 107 nt, Shigella flexneri 2a str. 2457T
gaaaaccuccggcuuccagguugagcauucccauaaacucagauccugcgugaagcagcaguaaaucugaguuuaugggaauaaauuaccugaaaaguagaguuuuc

SEQ ID NO: 4249055 - RNA, 61 nt, Shigella flexneri 2a str. 2457T
ugcgcuuuguuuaugucggaugcgacgcuaacgcgucuuauccgaccuacaaaaccgugca

SEQ ID NO: 4249056 - RNA, 73 nt, Shigella flexneri 2a str. 2457T
ugugccaguugcacuucaauuaauuguaagaccgcuuccugcauagcguugcucauauugaaguugacgcaca

SEQ ID NO: 4249057 - RNA, 70 nt, Shigella flexneri 2a str. 2457T
cgguauagcaucgcucaucaugaugucgcuuccggcaaugcgcacguuggcaugagcgauggcgguaucg

SEQ ID NO: 4249058 - RNA, 57 nt, Shigella flexneri 2a str. 2457T
ucaugcgcgaagcgguagcgauugucccggaagggcgucgcgucuucucgcggauga

SEQ ID NO: 4249059 - RNA, 72 nt, Shigella flexneri 2a str. 2457T
uacgcuguggaagcauugccaguaaggcgucagcacucuggcgcuguagaucugcauguugcucauagugug

SEQ ID NO: 4249060 - RNA, 80 nt, Shigella flexneri 2a str. 2457T
ggucugcaagccgacgaacauuacuggcuucauucagaauacguucugcaaugaccaguaaugcuuugcccgguucaguc

SEQ ID NO: 4249061 - RNA, 67 nt, Shigella flexneri 2a str. 2457T; identical to SEQ ID NO: 4228150

SEQ ID NO: 4249062 - RNA, 75 nt, Shigella flexneri 2a str. 2457T
cggaaccaaagcggcaaacuucgcggugcaggagugugaccugcugaucgccgugggugcacguuuugaugaccg

SEQ ID NO: 4249063 - RNA, 102 nt, Shigella flexneri 2a str. 2457T
gcugaucgccugaugcgacgcuuacgcgucuuaucaggccuacgagccaaugccauuuuguguaggcgggauaaggcguucacgccgcauccggcaucacgc

SEQ ID NO: 4249064 - RNA, 74 nt, Shigella flexneri 2a str. 2457T
cgcaggggcuggagauuaugcguaaagccauccaguucgcccaggacguuggcauucgcgugauccagcuggcg

SEQ ID NO: 4249065 - RNA, 69 nt, Shigella flexneri 2a str. 2457T
ucgauaaaaguuacugcggauuuauugccaucgucggacguccgaacguuggcaaauccacauuguuga

SEQ ID NO: 4249066 - RNA, 66 nt, Shigella flexneri 2a str. 2457T
gcgucaggucauugacaaugcugccgcucaccugagugaaguggcgcagggcgaugauguugacgc

SEQ ID NO: 4249067 - RNA, 82 nt, Shigella flexneri 2a str. 2457T
aaggcugugcguucucaucgcucuuaccggggaucuucacgauauacggcuucccgguaaucgaugacgacgaagcuaccuu

SEQ ID NO: 4249068 - RNA, 61 nt, Shigella flexneri 2a str. 2457T
ucaaacucccuuuacuuaccuuugagcgccaauuuaagcgggguaagugaagggaguguga

SEQ ID NO: 4249069 - RNA, 69 nt, Shigella flexneri 2a str. 2457T
gaacugcguacgccauuagcggugcugcgcggugaacuggaagccauucaggauggcgugcgcaaauuc

SEQ ID NO: 4249070 - RNA, 87 nt, Shigella flexneri 2a str. 2457T
gcggauuaucuguuccgugacgguucgaugauuggucugaauaaagauauucucugccaguacguugaauacaucaccaauauccgc

SEQ ID NO: 4249071 - RNA, 75 nt, Shigella flexneri 2a str. 2457T
agccacuguucauaggucagugacacauuaugacggaacacuuuuucaucgguuucaaugacuuuugcggcggcu

SEQ ID NO: 4249072 - RNA, 87 nt, Shigella flexneri 2a str. 2457T
gucggcguugauacuauguaugggguggcauucggcgaaaaaggcaugaauccgcugaccagaaccucguuuauuauuaccgaagau

SEQ ID NO: 4249073 - RNA, 63 nt, Shigella flexneri 2a str. 2457T
gguuuuuucuucaaugcgcuggcaaugauaccauucucugcaauccaggcauuaggaaaaucu

SEQ ID NO: 4249074 - RNA, 61 nt, Shigella flexneri 2a str. 2457T
gguauucgcuuugccuuuacgaucaugaacagcauagagaauaaagggcagggcaaguacc

SEQ ID NO: 4249075 - RNA, 56 nt, Shigella flexneri 2a str. 2457T
caucgcuggggauugguauuuuacugguugugaaaugcgccaaccuuccagcgaug

SEQ ID NO: 4249076 - RNA, 65 nt, Shigella flexneri 2a str. 2457T
ugagaucauguuguagcgcccgggauacugcaucaguugguuucgggcguucgagaguguucuua

SEQ ID NO: 4249077 - RNA, 60 nt, Shigella flexneri 2a str. 2457T
guggauacaguaucugcugagccugguccccuacugcccguggcagcauauuguguucac

SEQ ID NO: 4249078 - RNA, 66 nt, Shigella flexneri 2a str. 2457T
cuuacaucugucugauaaaaaacccgcuuuuugaagcggguuuuuuguaucgaacaagauauugag

SEQ ID NO: 4249079 - RNA, 74 nt, Shigella flexneri 2a str. 2457T
uacuguccguuuuucuucaguuguucgagaaugcguuuuacacccugaucaacagaauaaacggaagcguagua

SEQ ID NO: 4249080 - RNA, 65 nt, Shigella flexneri 2a str. 2457T
gcucacugcaggacaacaguaaaaucagagcguuucugcuuuuacugaugucuggcggucggagc

SEQ ID NO: 4249081 - RNA, 75 nt, Shigella flexneri 2a str. 2457T
uuggaucgaucgagaucgguaccgucacgccacguccacagccugguaaugacaagccgcgucucuuucgucugg

SEQ ID NO: 4249082 - RNA, 72 nt, Shigella flexneri 2a str. 2457T
gggagugcaaaaguggauauuuuauuaucuucauuacggaagguguuaaaugcucauuguuugccugguccu

SEQ ID NO: 4249083 - RNA, 65 nt, Shigella flexneri 2a str. 2457T
gccauggcggaaguccgaccuucagccguauugccgcuggcggcggauuuaucugccaucaaugc

SEQ ID NO: 4249084 - RNA, 61 nt, Shigella flexneri 2a str. 2457T
gcaacucucuacuguuucuccauacccguuuuuuuggauggagugaaacgauggcgauugc

SEQ ID NO: 4249085 - RNA, 65 nt, Shigella flexneri 2a str. 2457T
uguuaguucgaaaagcaaaaaggccauccuuucggauggccuuucgcuugauuugaugucuggca

SEQ ID NO: 4249086 - RNA, 78 nt, Shigella flexneri 2a str. 2457T
aggucuggcguauccagcgggauuaucucaagcuggucuucaccaaaugucgauaauuuuguuacauacagccgaucu

SEQ ID NO: 4249087 - RNA, 60 nt, Shigella flexneri 2a str. 2457T
cgcgcacuguuccauuaacuggcggccaaucucggucuaaccgguaaacgacaguuugcg

SEQ ID NO: 4249088 - RNA, 61 nt, Shigella flexneri 2a str. 2457T; identical to SEQ ID NO: 4228551

SEQ ID NO: 4249089 - RNA, 63 nt, Shigella flexneri 2a str. 2457T
agcgcaggcagaacggaauuaccaggagcaacagaaacgccggaaugcugaaaaugccgcgcu

SEQ ID NO: 4249090 - RNA, 73 nt, Shigella flexneri 2a str. 2457T
guugagauuuaacagaucgacugccagcaccucgcccaacggcggcuggcguucgcuuaguugauguuguaac

SEQ ID NO: 4249091 - RNA, 86 nt, Shigella flexneri 2a str. 2457T
cuucauacggcacuuucaucgcggucagcugcuguucgguuuugcccacagagcugauuuccgggaugguguaaaugccgguaggg

SEQ ID NO: 4249092 - RNA, 60 nt, Shigella flexneri 2a str. 2457T; identical to SEQ ID NO: 4228047

SEQ ID NO: 4249093 - RNA, 69 nt, Shigella flexneri 2a str. 2457T; identical to SEQ ID NO: 4227373

SEQ ID NO: 4249094 - RNA, 64 nt, Shigella flexneri 2a str. 2457T; identical to SEQ ID NO: 4227144

SEQ ID NO: 4249095 - RNA, 69 nt, Shigella flexneri 2a str. 2457T; identical to SEQ ID NO: 4228368

SEQ ID NO: 4249096 - RNA, 63 nt, Shigella flexneri 2a str. 2457T
guuuuauccauuuuugguuaccugagucauugaugguugauggcaaucagaacguggaagaac

SEQ ID NO: 4249097 - RNA, 77 nt, Shigella flexneri 2a str. 2457T
gaccgauccaguggcuguguaagaauccggaaacgcucacuuguuuccggauucuuuuaugcacauuggacaggcuc

SEQ ID NO: 4249098 - RNA, 60 nt, Shigella flexneri 2a str. 2457T
cagcgaugaggaaccauccugggcaacaucuuugccguuuuugaugguugcuuuuugcug

SEQ ID NO: 4249099 - RNA, 64 nt, Shigella flexneri 2a str. 2457T; identical to SEQ ID NO: 4227844

SEQ ID NO: 4249100 - RNA, 78 nt, Shigella flexneri 2a str. 2457T
ccgggcagugaugugauugucugcgcugaaauggacgaacauuggggcuacgucggugcuaaaucacgucagcgcugg

SEQ ID NO: 4249101 - RNA, 65 nt, Shigella flexneri 2a str. 2457T
cggccgaaccguggcugaugccauguagcucaaguaccugacugcguaauacagcccgucugccg

SEQ ID NO: 4249102 - RNA, 71 nt, Shigella flexneri 2a str. 2457T
ggcugguuuugacgauggcuuucaggucgccauaaaacaguugcgcuucaaaggugucgucaggauuggcu

SEQ ID NO: 4249103 - RNA, 69 nt, Shigella flexneri 2a str. 2457T
acgccuuauccggccuacaaguucgugcaaauucaauaaauugcaauaugacguaggccugauaagcgu

SEQ ID NO: 4249104 - RNA, 101 nt, Shigella flexneri 2a str. 2457T
ugcgccugcgccgaaaaauggucaggccguuggcaccaacaccauugguucuuccgaggccuguaugcucggcgggauggcgaugaaauggcguuggcgca

SEQ ID NO: 4249105 - RNA, 66 nt, Shigella flexneri 2a str. 2457T
agaaauuguugcacgccggagguuuguuuggcuuuuaacugacguuuguucugggcggcgauuucu

SEQ ID NO: 4249106 - RNA, 86 nt, Shigella flexneri 2a str. 2457T
cucauuaauacguugacacaggcgacgaaccguuuccagugcuccucuggccugaaccgguuguacggccugaaccaguguaugag

SEQ ID NO: 4249107 - RNA, 75 nt, Shigella flexneri 2a str. 2457T; identical to SEQ ID NO: 4228219

SEQ ID NO: 4249108 - RNA, 67 nt, Shigella flexneri 2a str. 2457T
auuguuuugcuaccaaaccucauggguggcaacggggcgcuacuauagggaguuggaguaaaacggu

SEQ ID NO: 4249109 - RNA, 71 nt, Shigella flexneri 2a str. 2457T
gcggcugcggugcaaccgguuguugcggcuguugauacugcggcugcggcgcaacugguuguugcggcugc

SEQ ID NO: 4249110 - RNA, 106 nt, Shigella flexneri 2a str. 2457T
ugccguuauggcaaagaauccgaguaaugugagcugcuuagcuuuaccugucuguacugauguagccauauuaucccccuaaaacgguauuccugucggaaccgca

SEQ ID NO: 4249111 - RNA, 68 nt, Shigella flexneri 2a str. 2457T
aaugcaccuucguagcuguggugagccagcggugcuggcucucccccauuuacggauaagaaugcauu

SEQ ID NO: 4249112 - RNA, 92 nt, Shigella flexneri 2a str. 2457T
guacgcuugcaaggcugaucgcugauauuaaagccacaacugauugccagugcguggugguugguggcagcguuggucuggcagaaggguau

SEQ ID NO: 4249113 - RNA, 106 nt, Shigella flexneri 2a str. 2457T
uggucacagcaaacucauauuucccgucuaugcuuucagagcaaugcaucgcgucugaccgauuucagacguaccacugacucucgaaaggagaagaggaugacca

SEQ ID NO: 4249114 - RNA, 62 nt, Shigella flexneri 2a str. 2457T
gcgcauggacgguacgaccccagaaguucaaacaaacagcacaagucguaucuucguugcgc

SEQ ID NO: 4249115 - RNA, 60 nt, Shigella flexneri 2a str. 2457T
uucguuuugcuaaggaugucaucgucaauaauaacgaggugauugaagagcaagaacgga

SEQ ID NO: 4249116 - RNA, 81 nt, Shigella flexneri 2a str. 2457T
gcaggagcagaacagguuacggucgccguaaacaucauccagacguuucaccgucggccaguauuugucugccacgccugc

SEQ ID NO: 4249117 - RNA, 59 nt, Shigella flexneri 2a str. 2457T
cggcggcggauuuauuacugcauccugccuaccaggaagcggcgggaauugugcugcug

SEQ ID NO: 4249118 - RNA, 73 nt, Shigella flexneri 2a str. 2457T
acugugguguuugccgaaaguggacgguaaauacauucagguauguaccuucaccguuggcggcaacuacggu

SEQ ID NO: 4249119 - RNA, 59 nt, Shigella flexneri 2a str. 2457T
gcccggaucgccuacgggcugaccgugucggcaauggugccagccugucaggucugggc

SEQ ID NO: 4249120 - RNA, 71 nt, Shigella flexneri 2a str. 2457T
caacuccggggaaauugucggucugcuggggccaaacggugccgguaagaccaccacuuucuacaugguug

SEQ ID NO: 4249121 - RNA, 75 nt, Shigella flexneri 2a str. 2457T
ucggugaccagcaaaugguugaaaucgccaaagugcugagcuuugagucgaaagucaucauuauggaugaaccga

SEQ ID NO: 4249122 - RNA, 57 nt, Shigella flexneri 2a str. 2457T
caguuaguguuucgcguugagaagacgauucaucuuuccaauagugaagaacggcug

SEQ ID NO: 4249123 - RNA, 94 nt, Shigella flexneri 2a str. 2457T
gccuugcucggcguggauuaucuuuuucuucuucgguaagcaggucaacccauugcuuaaccgugauagaagaugccggacgauuagggaaggc

SEQ ID NO: 4249124 - RNA, 81 nt, Shigella flexneri 2a str. 2457T
gcuucgcggcugaucuuuaucgacaaaggccggauugcggaagauggcaauccgcagguguugaucaagaacccgccgagc

SEQ ID NO: 4249125 - RNA, 113 nt, Shigella flexneri 2a str. 2457T
ccucgcgcauacaaccgggcagugaugugauugucugcgcugaaauggacgaacauuggggcuacgucggugcuaaaucacgucagcgcugguuguuuuacgcguaugacagg

SEQ ID NO: 4249126 - RNA, 84 nt, Shigella flexneri 2a str. 2457T
gcggcggaaaacccagcgaaaccguugagcgacagcaaguuaaccucuuugcugucggaacaagguaucaugguggcacgccgc

SEQ ID NO: 4249127 - RNA, 105 nt, Shigella flexneri 2a str. 2457T
uugucguuaucgcuguuaauguugauccagucagugguuugcccuucuuuuauuucugaaggaauauucaggcucugacuggcgcuacgggcggcuuugaaauaa

SEQ ID NO: 4249128 - RNA, 55 nt, Shigella flexneri 2a str. 2457T
aaucagcgguaucguuuccuucgguaaagaaaccaaagguaaacgucgucugguu

SEQ ID NO: 4249129 - RNA, 74 nt, Shigella flexneri 2a str. 2457T
gggccugaagguuucgguguuuauacaauugcaauugcacuuguuggguaugcuggaauuuuugauguaggccu

SEQ ID NO: 4249130 - RNA, 69 nt, Shigella flexneri 2a str. 2457T
auguucagucaguugauacuccaccugcgaggggagacuuuccgguuuugggaucaccugaugauccau

SEQ ID NO: 4249131 - RNA, 59 nt, Shigella flexneri 2a str. 2457T
uucauggcgaucaggugcuggcgcagccgcugggugcugaccguaaaggucgucgugaa

SEQ ID NO: 4249132 - RNA, 130 nt, Shigella flexneri 2a str. 2457T
cggggccgggacguuaucccaaccugagcgcguagaaggcgcagcacguugcggcugcguuugcgccaccugugcaggggccgcgacguugcucgucacugccgcuuguggcguuugcgucaccgguuug

SEQ ID NO: 4249133 - RNA, 67 nt, Shigella flexneri 2a str. 2457T
gcagagcggcggucugaucacccguuaagcggcgagcaccgccgggugcaguaauaucgcccugagc

SEQ ID NO: 4249134 - RNA, 82 nt, Shigella flexneri 2a str. 2457T
guauuuaugcuuucgguauuggucuggcgaaugcgggacuggugcgauuaacccuguuugccagcgauaugaguaaagguac

SEQ ID NO: 4249135 - RNA, 73 nt, Shigella flexneri 2a str. 2457T
cugguggggcuuggcguuuugcuguuauuggggcugauuuccgacagccagaccagccgcgccuggacgccgg

SEQ ID NO: 4249136 - RNA, 56 nt, Shigella flexneri 2a str. 2457T
aucggauggucgaacggcggcacccaggugaaccccugcugcugugacaguucgau

SEQ ID NO: 4249137 - RNA, 96 nt, Shigella flexneri 2a str. 2457T
ccaacguuacgguuugugcgggaguauaaguaccgccuuucaucacccaugcagguagcuuaugcccuugcaccaucugauuaaacgcagcuuugg

SEQ ID NO: 4249138 - RNA, 62 nt, Shigella flexneri 2a str. 2457T
gggcuggauauuauggcgcuggucgccgggaaacagguugccauuccggauauugcagaccu

SEQ ID NO: 4249139 - RNA, 69 nt, Shigella flexneri 2a str. 2457T
auacgccuuuuaagauaagucagccccggcuggauccagucaucaggcucuuucuuaaagggggaguau

SEQ ID NO: 4249140 - RNA, 55 nt, Shigella flexneri 2a str. 2457T
cgacggcaauauuguacugaguuaucaggaacaucagccgcaggaguugccguug

SEQ ID NO: 4249141 - RNA, 90 nt, Shigella flexneri 2a str. 2457T
gccgaugguguggauauuaugggguacaccaguugggggccaauugauuuagucagugcaucucauucacaaaugucuaagcgcuacggc

SEQ ID NO: 4249142 - RNA, 79 nt, Shigella flexneri 2a str. 2457T; identical to SEQ ID NO: 4227127

SEQ ID NO: 4249143 - RNA, 76 nt, Shigella flexneri 2a str. 2457T
cggcuuucugcuggcgauagccaauaaguugcugaugcgccgcccgaccuggcuuaucgcgcggcagaaauugcug

SEQ ID NO: 4249144 - RNA, 62 nt, Shigella flexneri 2a str. 2457T
cgauuugcucgucagccaguuucagcgugcguagcgcgugaggcaggguacgggcagcuucg

SEQ ID NO: 4249145 - RNA, 63 nt, Shigella flexneri 2a str. 2457T
ucugcugccugacguugcagcucgccgagaucaucgcucaccaguugcaggucagccaucggg

SEQ ID NO: 4249146 - RNA, 73 nt, Shigella flexneri 2a str. 2457T
ucgccggaagaucuauaugccggauuagcgaacuuagccaguggcgcuaucaggggaugguagggcgaggcga

SEQ ID NO: 4249147 - RNA, 74 nt, Shigella flexneri 2a str. 2457T
aaaggugguggugaagguuaaggcugauuuaauggcuuaaauuuauuagaucaggugugaccugacccaucuuu

SEQ ID NO: 4249148 - RNA, 66 nt, Shigella flexneri 2a str. 2457T
ugauugagaagauggugaacagggcggcguccagcgcacgcucaauaucggcaucuucaaaaauca

SEQ ID NO: 4249149 - RNA, 63 nt, Shigella flexneri 2a str. 2457T
ugaugugauugucugcgcugaaauggacgaacauuggggcuacgucggugcuaaaucacguca

SEQ ID NO: 4249150 - RNA, 92 nt, Shigella flexneri 2a str. 2457T
cgcagaccguggcgauuggcgauggagcuaaugaccugccgaugaucaaagcagcagggcuggggauugccuaccaugccaagccaaaagug

SEQ ID NO: 4249151 - RNA, 109 nt, Shigella flexneri 2a str. 2457T
agcaugcuaagugacuggaugaagccaaaugaaagacugagcguuuuguugaucaguaagagaaugucuucagcgauacguuggucaggguuaucuguauuuuuaugcu

SEQ ID NO: 4249152 - RNA, 69 nt, Shigella flexneri 2a str. 2457T; identical to SEQ ID NO: 4228074

SEQ ID NO: 4249153 - RNA, 80 nt, Shigella flexneri 2a str. 2457T
ggcuuugacggagcggcuuuccggcgagguggcgcagcauacauugcgucugccaccgcaggaagggcgucugaggaguc

SEQ ID NO: 4249154 - RNA, 77 nt, Shigella flexneri 2a str. 2457T
gggaaugaauuuucaggaauuucgccagugcauccgccacaaaacggguauugcagccguuuuugaggauucuaacc

SEQ ID NO: 4249155 - RNA, 58 nt, Shigella flexneri 2a str. 2457T
uugcgcacguaauugauccagaagugcuuguacgcgucugcuuaccauugcgugccaa

SEQ ID NO: 4249156 - RNA, 63 nt, Shigella flexneri 2a str. 2457T
accucgggacuuuaaucaauuaucaggccuuacugguggguaaucugaucggugucccgcugu

SEQ ID NO: 4249157 - RNA, 79 nt, Shigella flexneri 2a str. 2457T
gccggagcaguaaugggggcauuuaucauggcuucacuggauaacggcaugaguaugauggauguaccgaccuucuggc

SEQ ID NO: 4249158 - RNA, 93 nt, Shigella flexneri 2a str. 2457T
caacaaugagucagaauguuuaucaauuuaucgaccugcagcgcguugauccgccaaagaaaccgcugaagauccguaaaauugaguuuguug

SEQ ID NO: 4249159 - RNA, 62 nt, Shigella flexneri 2a str. 2457T
ggcuuucaguauuuguggcaaugagccugaccccugcccugugcgccaccauucugaaagcc

SEQ ID NO: 4249160 - RNA, 105 nt, Shigella flexneri 2a str. 2457T
cccggcggcugcaugugcugcguuaaugguuuacccaugcagguaggguugaauaccuuacugcgucagggaaaaccagaccgcuuguugauagagccgaccggg

SEQ ID NO: 4249161 - RNA, 61 nt, Shigella flexneri 2a str. 2457T
uuauccggccuacaugaucucugcaauauauugaauuugcgugauuauguaggccggauaa

SEQ ID NO: 4249162 - RNA, 78 nt, Shigella flexneri 2a str. 2457T
gauggauaaacuaugguuggcgcuggcgggggugaaacgagaaaauucaccgacguuagaaaucaaccaucggccauu

SEQ ID NO: 4249163 - RNA, 66 nt, Shigella flexneri 2a str. 2457T
guggcuuucagaaugguggcgcacagggcaggggucaggcucauugccacaaauacugaaagccgc

SEQ ID NO: 4249164 - RNA, 90 nt, Shigella flexneri 2a str. 2457T
cggucggccuguauaugcuggugggcgcgaugcagcucggcgugauguauaugcugaguuuccgcgcuuaucucuaccugacggucuccg

SEQ ID NO: 4249165 - RNA, 58 nt, Shigella flexneri 2a str. 2457T
acagcgaggcaccaucauugagauguuuaacauguucucugguggugcucucagccgu

SEQ ID NO: 4249166 - RNA, 71 nt, Shigella flexneri 2a str. 2457T
ccgcaaugggcgugggaugugggccugaacggucguccacaugauuuagguaauaucucagcuuaucucgg

SEQ ID NO: 4249167 - RNA, 58 nt, Shigella flexneri 2a str. 2457T
auucgcuuggguauuguaaaaccauggaacucuacuugguuugcgaacaccaaagaau

SEQ ID NO: 4249168 - RNA, 113 nt, Shigella flexneri 2a str. 2457T
ccucgcgcauacaaccgggcagugaugugauugucugcgcugaaauggacgaacauuggggcuacgucggugcuaaaucacgucagcgcuggcuguuuuacgcguaugacagg

SEQ ID NO: 4249169 - RNA, 80 nt, Shigella flexneri 2a str. 2457T
accugccgcaaccuguuuguuaccaggcuggaggaaaucuucuuccguuaccggcgugccaacaggcguaacgcggcggu

SEQ ID NO: 4249170 - RNA, 124 nt, Shigella flexneri 2a str. 2457T
ggccuggcggcagcucaucuaucaccgagguaucgagaucggcauacgccgucauugccagcgugcgggggaucggcguggcggucaugaucaacugaugcggauggaagcccugcugcuggcc

SEQ ID NO: 4249171 - RNA, 62 nt, Shigella flexneri 2a str. 2457T
gcuccuuaucccagucguggaucaacugaauaaaggcuugcuccauggugggaucggguugc

SEQ ID NO: 4249172 - RNA, 57 nt, Shigella flexneri 2a str. 2457T
gcgcggcaugaccaucgaucucggcuaugccuacuggccgcagccggauggucgcgu

SEQ ID NO: 4249173 - RNA, 87 nt, Shigella flexneri 2a str. 2457T
gauuaucgcggaaaaauugccgaugcacgcuggcguaaaaugugggaugccggucuggucaucggcagucuggugccgccgguaguc

SEQ ID NO: 4249174 - RNA, 71 nt, Shigella flexneri 2a str. 2457T
ugcccaacuggaagaacuggcgacgcgagucgaagcacaaggcuuucgcccguaugucauuccgguuggcg

SEQ ID NO: 4249175 - RNA, 67 nt, Shigella flexneri 2a str. 2457T
ggagugggcgacgccaggcugaauguugucgauauuuucaaucgcuucaacgcagcguugccacuuc

SEQ ID NO: 4249176 - RNA, 65 nt, Shigella flexneri 2a str. 2457T
gcgucgucuggagguguuguaucagugcaguguucccaggcgcugaacaccagccagauugaugu

SEQ ID NO: 4249177 - RNA, 57 nt, Shigella flexneri 2a str. 2457T
caggucgauaaauauaccuggcgcgauauuggcuccagcuauuugauguccgaucug

SEQ ID NO: 4249178 - RNA, 56 nt, Shigella flexneri 2a str. 2457T
gcgcuuuguuuaugccagaugcgacgcugacgcgucuuaucuggccuacaaagggc

SEQ ID NO: 4249179 - RNA, 55 nt, Shigella flexneri 2a str. 2457T
cugggcuaacgccgaugaaagccagauuuuugccuccuguacggugucagcccag

SEQ ID NO: 4249180 - RNA, 62 nt, Shigella flexneri 2a str. 2457T
ugcccgucagguccgugugguaauaccagauuuucuggcucucuccgcgccccgugauggca

SEQ ID NO: 4249181 - RNA, 59 nt, Shigella flexneri 2a str. 2457T; identical to SEQ ID NO: 4227874

SEQ ID NO: 4249182 - RNA, 83 nt, Shigella flexneri 2a str. 2457T
aagcagcaaucucugccggacugaaaauugaugacuucgcuccucgccugucguuauucuucgguaucggcauggaucuguuu

SEQ ID NO: 4249183 - RNA, 84 nt, Shigella flexneri 2a str. 2457T
auugcagcuguggacgcgguuuaaccgacgcggagagauacguccguucuucgucagucaggacaaacugcgcccgguugcgau

SEQ ID NO: 4249184 - RNA, 76 nt, Shigella flexneri 2a str. 2457T
ccucuucuccuuucgagagucagugguacgucugaaaucggucagacgcgaugcauugcucugaaagcauagacgg

SEQ ID NO: 4249185 - RNA, 59 nt, Shigella flexneri 2a str. 2457T
ucuggcuacucaggcgauacaguguggcgaggcugauauugucaucgcagguggccagg

SEQ ID NO: 4249186 - RNA, 57 nt, Shigella flexneri 2a str. 2457T
accguuucuugauggcgaguauuggccuuggugccauucuugcggugaagaagaggu

SEQ ID NO: 4249187 - RNA, 117 nt, Shigella flexneri 2a str. 2457T
ucuuuguaauaacgagcagacagcguacgggugacgcuuugcggauuguucggauaaaccauuccauaaccgaagccguuaccgcgcgccugauguuuuuucgcauaucgauagagg

SEQ ID NO: 4249188 - RNA, 57 nt, Shigella flexneri 2a str. 2457T; identical to SEQ ID NO: 4227166

SEQ ID NO: 4249189 - RNA, 59 nt, Shigella flexneri 2a str. 2457T
gauucgcaugaugccgauggaauaugucuuuagucgcuauccccggcuggugcgugauc

SEQ ID NO: 4249190 - RNA, 61 nt, Shigella flexneri 2a str. 2457T; identical to SEQ ID NO: 4227193

SEQ ID NO: 4249191 - RNA, 58 nt, Shigella flexneri 2a str. 2457T
agcguauuaagaaugagcuggaacccaaaaugggcauggagcucaaucugguacagcu

SEQ ID NO: 4249192 - RNA, 73 nt, Shigella flexneri 2a str. 2457T
gacagcguaaucaccacguuucaggacaaacguuuugguaaacguguugccugccgcgucgguauacgucauc

SEQ ID NO: 4249193 - RNA, 61 nt, Shigella flexneri 2a str. 2457T
gguaaaauagauuucgccauuaccgcuuucgcuuaaagcgucuuuggcauuuauuuuuacc

SEQ ID NO: 4249194 - RNA, 99 nt, Shigella flexneri 2a str. 2457T
gcggaucucauccagcgguugaugggcggauucuugcgacaggaguucaagcauuuguucgaggaccuggcgagcaucccccacaaucgggauauccgc

SEQ ID NO: 4249195 - RNA, 117 nt, Shigella flexneri 2a str. 2457T
uguuuggccgcgccaaugccugaugcgacgcuugcagcgucuuaucaggccuacaaaugcucuccguaggccagauaaggcguuuacgccgcauccggcaauugugauggucagaca

SEQ ID NO: 4249196 - RNA, 69 nt, Shigella flexneri 2a str. 2457T; identical to SEQ ID NO: 4227598

SEQ ID NO: 4249197 - RNA, 69 nt, Shigella flexneri 2a str. 2457T; identical to SEQ ID NO: 4227301

SEQ ID NO: 4249198 - RNA, 97 nt, Shigella flexneri 2a str. 2457T
gcuguaggagcgaacgucugguucagcagauuuggcgcaacuggcagauugugguucggguucguagucgcucugaacuugcguuucugcuuacagc

SEQ ID NO: 4249199 - RNA, 73 nt, Shigella flexneri 2a str. 2457T
ucuuuuucgcguaaacgccaggcguguaauaacgguucgguauaaccguuuggcuguuucacgccgaggaaga

SEQ ID NO: 4249200 - RNA, 83 nt, Shigella flexneri 2a str. 2457T
uaucggcagcggcgaucgugagcguauuggugaauugcacgaaggugcauugcugguacuuucacagggacgagucgucgaua

SEQ ID NO: 4249201 - RNA, 84 nt, Shigella flexneri 2a str. 2457T
gcagcgcgugcaguucuccuucaacaaacagugcgccgggguaaucugucgucgccugaaguugaggaggauaaaauucgcugu

SEQ ID NO: 4249202 - RNA, 98 nt, Shigella flexneri 2a str. 2457T
uacguuuaucacgaugggcauuauuacuguugcuucagcagcaauguucaugcuucugaaaacaaccgaugguaauaauuugaucaaaagacagcgua

SEQ ID NO: 4249203 - RNA, 71 nt, Shigella flexneri 2a str. 2457T
ccugcugguagcgcuggggcugcaaaaacauaacaucgugguuugcgauucaaaaggcguuaucuaucagg

SEQ ID NO: 4249204 - RNA, 60 nt, Shigella flexneri 2a str. 2457T
gauagccauaauaugccucuuuuaaugcuauuuucguuaacugaggugauuaugggcuuc

SEQ ID NO: 4249205 - RNA, 65 nt, Shigella flexneri 2a str. 2457T
augcuggcugaaaacaccgcggacgaagaugcugccgaagccgccgcgcaggugcuuuccagcgu

SEQ ID NO: 4249206 - RNA, 88 nt, Shigella flexneri 2a str. 2457T
uuguaggccggauaaggcguuuacgccgcauccggcgguugugcacggaugccugaugcgacgcugacgcgucuuaucaugccuacaa

SEQ ID NO: 4249207 - RNA, 79 nt, Shigella flexneri 2a str. 2457T
gaugucugcgguuuaagucggucaaguaauuaucuuuacugauaauuuuuucacuacguagaucauagagcacggcauc

SEQ ID NO: 4249208 - RNA, 57 nt, Shigella flexneri 2a str. 2457T
gugggaauacgugucagcgaucagcuggaaaggcugcuguggcgcaguauuccgcac

SEQ ID NO: 4249209 - RNA, 55 nt, Shigella flexneri 2a str. 2457T
uuggucagcguuaacguaucgccagaaauggugauaucacugucaaugcgaccga

SEQ ID NO: 4249210 - RNA, 75 nt, Shigella flexneri 2a str. 2457T
auugauuuucaaacccgucagaaugccgggcgauaucagcaaguaucuuggcgguucugcggguaugccagcgau

SEQ ID NO: 4249211 - RNA, 55 nt, Shigella flexneri 2a str. 2457T
gguucugcgggaauacgguuuugcugaggcaaaacuguuuaucaccgcagcaacc

SEQ ID NO: 4249212 - RNA, 85 nt, Shigella flexneri 2a str. 2457T
ccgcguugaaaucugccgacguacagcuggugaccuacgucccgccaccgucugaaaccaacuacucggcagcauuuuuaaccgg

SEQ ID NO: 4249213 - RNA, 62 nt, Shigella flexneri 2a str. 2457T
uguugaaacuguagcccguucccgacuguuuaccgucgagagcguggaucuggaguucagca

SEQ ID NO: 4249214 - RNA, 55 nt, Shigella flexneri 2a str. 2457T
ggauuuucgcugcgguugcuggcugauggagaaaccggaaaccgcaaugaaagcc

SEQ ID NO: 4249215 - RNA, 58 nt, Shigella flexneri 2a str. 2457T; identical to SEQ ID NO: 4227721

SEQ ID NO: 4249216 - RNA, 65 nt, Shigella flexneri 2a str. 2457T
gccaacaucauaggcgugguguuuaccgagauuaaaagcaauaacgccaagccuguuuuguuggc

SEQ ID NO: 4249217 - RNA, 67 nt, Shigella flexneri 2a str. 2457T
ggguugcgcaucgugguguggguuaucgccacucugauuggccugaucuuuaccaugguguacgccu

SEQ ID NO: 4249218 - RNA, 121 nt, Shigella flexneri 2a str. 2457T
gguccccggcucgcgcauuggucuguuaggccgcaacggcgcagguaaaucgacauuaaucaaacuguuagccggugaacuugcgccagucagcggugaaauuggucuggcgaaagggauc

SEQ ID NO: 4249219 - RNA, 55 nt, Shigella flexneri 2a str. 2457T
uggugaaguuauuaacucagcaacuucggugaguuccugauuauaaauuucgcca

SEQ ID NO: 4249220 - RNA, 60 nt, Shigella flexneri 2a str. 2457T
agcgugauagcggguuuacucauuauguccucggcaauaaagggggcuggcuaucaaacu

SEQ ID NO: 4249221 - RNA, 57 nt, Shigella flexneri 2a str. 2457T
ccucgcugaucccaggacuucugcgccagcacacggaaacucucggggucagcgagg

SEQ ID NO: 4249222 - RNA, 75 nt, Shigella flexneri 2a str. 2457T
gcauuacgcacaauuuucagcgcaaucuccagacgugccgccagugaggcgcugaacgugguggugcguuuuugc

SEQ ID NO: 4249223 - RNA, 66 nt, Shigella flexneri 2a str. 2457T
caucggucgcuucgucaucaaccacaguuuuauucugccgggguugauuggugugagcguaucgug

SEQ ID NO: 4249224 - RNA, 63 nt, Shigella flexneri 2a str. 2457T
cagaauauuugccauaagggaaugaguguuauaucaugcuuucuacccugguaaguauauuug

SEQ ID NO: 4249225 - RNA, 96 nt, Shigella flexneri 2a str. 2457T
gaaacccauauguacucccuauaagaaaauuacucauuguuuaaaaagagauuuuaucucuuaagcguaguaauuuuagcggagccugccaguuuc

SEQ ID NO: 4249226 - RNA, 96 nt, Shigella flexneri 2a str. 2457T
gcgaaguuguugauugauccuugcgcgcggcaaauugacggggaguuuaaagauaacccgcugcugcacgccggucauaaugaaccugacuaucgc

SEQ ID NO: 4249227 - RNA, 62 nt, Shigella flexneri 2a str. 2457T
agcuggcguugcgcggaguacgugggaacggaaucacaucacgcacguuuugcacgccaguu

SEQ ID NO: 4249228 - RNA, 86 nt, Shigella flexneri 2a str. 2457T
auuuuuauagauuaauuaaagaugucgaucuugaaaacuaugauuauaucuguuuuagugaucaggacgauauuugguauaaagau

SEQ ID NO: 4249229 - RNA, 61 nt, Shigella flexneri 2a str. 2457T
ggugaagugcaacggcuugcagaucaauauguugauggcugccgccgucugcgccgucauc

SEQ ID NO: 4249230 - RNA, 62 nt, Shigella flexneri 2a str. 2457T
cagcaagucggacaagaaaacccgucugguucauacccugaacgguucuggucuggcuguug

SEQ ID NO: 4249231 - RNA, 107 nt, Shigella flexneri 2a str. 2457T
aguaagaugcuuuacgccugaugcgcugcgcuuaucaggccuacgagacguaucuacccguaggccggauaaggcguagacgcauccggcaaaagccgccucauacu

SEQ ID NO: 4249232 - RNA, 76 nt, Shigella flexneri 2a str. 2457T
gcgcacaggcugcccaguugugaugauuuugugccagugccuggcgaauaguuucacgcuggaacgcuucugucgc

SEQ ID NO: 4249233 - RNA, 65 nt, Shigella flexneri 2a str. 2457T
augcgcuggggaaaauggauaaauggcuguaugccgauaucacgcacuuuucccaguacuggcau

SEQ ID NO: 4249234 - RNA, 57 nt, Shigella flexneri 2a str. 2457T; identical to SEQ ID NO: 4227248

SEQ ID NO: 4249235 - RNA, 129 nt, Shigella flexneri 2a str. 2457T
caagugcgcuuucuuaaugccugaugcggcguuaacgccuuauccggccuacaaaguccugcagauucaauauauuacagguacugcguaggccugauaagcguagcgcaucaggcuauuuugcauuug

SEQ ID NO: 4249236 - RNA, 79 nt, Shigella flexneri 2a str. 2457T
ucaacccgguugcuuucgucgagaauguagauauuaaagccauucucgucuugcguuucuucgaaaaagaacuggauga

SEQ ID NO: 4249237 - RNA, 77 nt, Shigella flexneri 2a str. 2457T
gcuucugcacugugguuuuucuuaaccugguucccgaacuauuuaacccaggaaaaaggaaucacggcgcugaaagc

SEQ ID NO: 4249238 - RNA, 94 nt, Shigella flexneri 2a str. 2457T
uccugugccugaugcgacgcuggcgcgucuuaucaggccuacaaauccgagccguaggccggauaaggcguucacgcugcauccggcacccgga

SEQ ID NO: 4249239 - RNA, 56 nt, Shigella flexneri 2a str. 2457T
uacaugccaaagauguuuugaugauauuaguugaucaaugucauugguuggcagua

SEQ ID NO: 4249240 - RNA, 76 nt, Shigella flexneri 2a str. 2457T
aacuggcucuggaagcgggguugcugacgcuugaugaugacuacagcaaacugcuuucuccggaguuuaaacaguu

SEQ ID NO: 4249241 - RNA, 104 nt, Shigella flexneri 2a str. 2457T
gcggcgauuuuacucgguuccguagccgguggugugcuggcugacuggcauguccuggucgcucuggccgcaugcgcacuggccuacgguggugcggucguugc

SEQ ID NO: 4249242 - RNA, 117 nt, Shigella flexneri 2a str. 2457T
gaguuuaaugaugucgcuuacuggccgcagaucaaacaggugcuggaguggucgaaagaucacgucaccucgacgcuguuugucugcugggcgguacaggccgcgcucaauauccuc

SEQ ID NO: 4249243 - RNA, 79 nt, Shigella flexneri 2a str. 2457T
guuacgcuggcuuugcgcacuggcggcuuccagcacaugguugaucuccagcugccaggccucaaaguuaacgucaaac

SEQ ID NO: 4249244 - RNA, 63 nt, Shigella flexneri 2a str. 2457T
cuuauccggccuacaaacccuugcuaauucaaucuauugcagggacuauguaggccugauaag

SEQ ID NO: 4249245 - RNA, 79 nt, Shigella flexneri 2a str. 2457T
cggauugaacugucgcuggagccuguugggugacacgauacuggccucgccuuuacgugcccgcgggcuucgguauccg

SEQ ID NO: 4249246 - RNA, 58 nt, Shigella flexneri 2a str. 2457T
gcacccguaacauggcgguaauggcgcucucagcuggcguaccggacaugauuacugc

SEQ ID NO: 4249247 - RNA, 65 nt, Shigella flexneri 2a str. 2457T
guacguuauccaucaccagaaucgcaucguucucaucgaagcggcuggagagcggguagucguau

SEQ ID NO: 4249248 - RNA, 80 nt, Shigella flexneri 2a str. 2457T
uagcuccguuacuggagguggaagggaugaaggucggucugaugaccuguuaugacuuacgcuuuccagagcuggcgcug

SEQ ID NO: 4249249 - RNA, 64 nt, Shigella flexneri 2a str. 2457T
ggaagugaucaccgcuugauccaggacgauaucccguuccagcaagcgccaguugucaucuucc

SEQ ID NO: 4249250 - RNA, 79 nt, Shigella flexneri 2a str. 2457T
auacgcggcgacccagguugacggucaacgcaaagacuuuauccgucugggcgugcugggcgacuggucgcacccguau

SEQ ID NO: 4249251 - RNA, 58 nt, Shigella flexneri 2a str. 2457T
gcccgagguaaucugaaaaaggugcaaucuuuugcaccuuuaacagguuagcucgggc

SEQ ID NO: 4249252 - RNA, 92 nt, Shigella flexneri 2a str. 2457T; identical to SEQ ID NO: 4228350

SEQ ID NO: 4249253 - RNA, 107 nt, Shigella flexneri 2a str. 2457T
agaaacgcgcgcuuuaaaagaagcuggaucucugaaaggauuauggcgcaaucgccgugcauucaucaugguucucgguuuuaccgcugcgggcucccuuuguuucu

SEQ ID NO: 4249254 - RNA, 59 nt, Shigella flexneri 2a str. 2457T; identical to SEQ ID NO: 4227875

SEQ ID NO: 4249255 - RNA, 68 nt, Shigella flexneri 2a str. 2457T
uaaucacguuaucgcccaguucaacgccggacucaaucaccgcguuagcgccaaucgauacguuguua

SEQ ID NO: 4249256 - RNA, 72 nt, Shigella flexneri 2a str. 2457T; identical to SEQ ID NO: 4228154

SEQ ID NO: 4249257 - RNA, 59 nt, Shigella flexneri 2a str. 2457T
gugaacgugugccagguaccauugguuuugcuaccgugcgugcaggugacaucguuggc

SEQ ID NO: 4249258 - RNA, 72 nt, Shigella flexneri 2a str. 2457T
guuccucgaaguuuauccgcaagguuucaguggcgaaaauauuacugaugccauugcugaauuugagaaaac

SEQ ID NO: 4249259 - RNA, 70 nt, Shigella flexneri 2a str. 2457T
caggcgaaugcguuucagccacgcguuugggccaaugccuaaaauagcgugaaacgcguuuuguagcgug

SEQ ID NO: 4249260 - RNA, 56 nt, Shigella flexneri 2a str. 2457T; identical to SEQ ID NO: 4228131

SEQ ID NO: 4249261 - RNA, 71 nt, Shigella flexneri 2a str. 2457T
uaauguuuucaauuucauauucauguuaagcgagauuuugugccuggcaggccauuggguugagaauauua

SEQ ID NO: 4249262 - RNA, 89 nt, Shigella flexneri 2a str. 2457T
gaacgucaacguaaguguggguuucaguaccguucggguagaucucuuuuaccgaaggggcgaaaacuaaauccacuuuacguuuguuu

SEQ ID NO: 4249263 - RNA, 58 nt, Shigella flexneri 2a str. 2457T; identical to SEQ ID NO: 4228188

SEQ ID NO: 4249264 - RNA, 86 nt, Shigella flexneri 2a str. 2457T
agcgccuuacgcgccgcuuugaucaccaguucacacuguucaauggucagugucaguggcgguucaaugcggaucguuuuggcguu

SEQ ID NO: 4249265 - RNA, 60 nt, Shigella flexneri 2a str. 2457T; identical to SEQ ID NO: 4227990

SEQ ID NO: 4249266 - RNA, 55 nt, Shigella flexneri 2a str. 2457T
ucgcucuuucugcucuuucugcucuuucucccgcagcaauggcagcgaaagggga

SEQ ID NO: 4249267 - RNA, 63 nt, Shigella flexneri 2a str. 2457T
auuacugaugaccagugcgcccucuucuucuucuuuccaggcgguccacggcucaucauuaau

SEQ ID NO: 4249268 - RNA, 57 nt, Shigella flexneri 2a str. 2457T
ccucgcugaccccgagaguuuccgugugcuggcgcagaaguccugggaucagcgagg

SEQ ID NO: 4249269 - RNA, 57 nt, Shigella flexneri 2a str. 2457T
ugcgagcgaugucugccggguucggguacggcaucaccuggcauucauucuucugca

SEQ ID NO: 4249270 - RNA, 56 nt, Shigella flexneri 2a str. 2457T; identical to SEQ ID NO: 4227353

SEQ ID NO: 4249271 - RNA, 82 nt, Shigella flexneri 2a str. 2457T
ggagguaaucuuugaugaugucgugacuaauaugagcaaccaaaguguuguuaagagaggagacgucgauaauauuauuuuc

SEQ ID NO: 4249272 - RNA, 109 nt, Shigella flexneri 2a str. 2457T
guaaaaucagccacccacagcuggucaggucguucugccacgaacugacgguuuacgcggucgccugcggcaacggcuuuccggcugauggucguacggaccuuuuuac

SEQ ID NO: 4249273 - RNA, 73 nt, Shigella flexneri 2a str. 2457T
ggcuuuaucaccauuugccgaugcguuuuagcuuaacgguagaacgcggcgagcagguggcaauccucgggcc

SEQ ID NO: 4249274 - RNA, 61 nt, Shigella flexneri 2a str. 2457T
ggcaaguugccagcccgcagccauuaucacuggugaugagugguugccacuggucaaugcc

SEQ ID NO: 4249275 - RNA, 55 nt, Shigella flexneri 2a str. 2457T
gccguuuauuuguuguaacucgccauuaagcgauuucugcacacgauaaacaggc

SEQ ID NO: 4249276 - RNA, 62 nt, Shigella flexneri 2a str. 2457T
aucgucgaaacgccggagcaggcuguucagccuguuugccagccgguuuucacccagacgau

SEQ ID NO: 4249277 - RNA, 72 nt, Shigella flexneri 2a str. 2457T
cagcgccgcguuggucaucgcuucacuacgccgggcaucaauaagcguagugcgguuaaccagcgccgccug

SEQ ID NO: 4249278 - RNA, 74 nt, Shigella flexneri 2a str. 2457T
gccugaggucuggcaguggguacgcagcgccagugauuucggauccugugcgccaaauccacugaccgcuucgc

SEQ ID NO: 4249279 - RNA, 110 nt, Shigella flexneri 2a str. 2457T
ugaauugcgggaucagcugugauuugcuccagucuucacuuuucgacaccccgguaaaggagucgagaaagaagagaauggcggcaacaaucaacacaccgcgcaacgca

SEQ ID NO: 4249280 - RNA, 89 nt, Shigella flexneri 2a str. 2457T; identical to SEQ ID NO: 4227126

SEQ ID NO: 4249281 - RNA, 70 nt, Shigella flexneri 2a str. 2457T
cgguugcaggccguaaaacgccgcuucgccgcucauugccgcacuggcggcuucuacggcaucugcgccg

SEQ ID NO: 4249282 - RNA, 57 nt, Shigella flexneri 2a str. 2457T
gcaagcugguucagguucgucgugaaauucuccauacguuccuccccaccagcuugu

SEQ ID NO: 4249283 - RNA, 87 nt, Shigella flexneri 2a str. 2457T
gcggcguuauugcuucugguaaucgcaacuuuggugaggcguauggccgcgccggagaugugauugcccggaaaugcggcgugccgu

SEQ ID NO: 4249284 - RNA, 59 nt, Shigella flexneri 2a str. 2457T
cgguaccagcgaagaacaacugcuuaacgaucugagcaacguugaucugcuggugaucg

SEQ ID NO: 4249285 - RNA, 115 nt, Shigella flexneri 2a str. 2457T
uaccgacgaaggcauucagaaaccguuccucgccauuuucgucuggaccgugguguucucgcugaucacugucuuuuuaacgguggcggucggcaugguucuggcaugucuggug

SEQ ID NO: 4249286 - RNA, 55 nt, Shigella flexneri 2a str. 2457T
accaggaccaaaacgaaaagagacgcuuuucagcgucucuuuucuggaauuuggu

SEQ ID NO: 4249287 - RNA, 82 nt, Shigella flexneri 2a str. 2457T
gcgggauccccaguaauaugauguuagcgaaaauuggcgcucgucgauggaucgcugggaucaugguggucuggggaauugc

SEQ ID NO: 4249288 - RNA, 58 nt, Shigella flexneri 2a str. 2457T
ccagguuauugggcgauacacccuucagggucaaauuaaugucuugccauugaccugg

SEQ ID NO: 4249289 - RNA, 73 nt, Shigella flexneri 2a str. 2457T
ggcugccaguagugccauuguggucggugccacagucgcaaccgaaccggcuauaccuuacgcucuggcagcu

SEQ ID NO: 4249290 - RNA, 104 nt, Shigella flexneri 2a str. 2457T
accggcuuaacgauguuaucgaugugauagauuggauaagaaacgcggguguucucgguuuuugaaccaucaucaaagucgauagugccaucuucacgcacggu

SEQ ID NO: 4249291 - RNA, 59 nt, Shigella flexneri 2a str. 2457T
cccacgauucauaauggcgaugcgccccgccauggucaucgccucuuccugaucguggg

SEQ ID NO: 4249292 - RNA, 67 nt, Shigella flexneri 2a str. 2457T
gcaggcgagccgcuucuuccagcaggaucugccgcacuuccuguuccgaggaggcgaucgcaucugc

SEQ ID NO: 4249293 - RNA, 62 nt, Shigella flexneri 2a str. 2457T
guugaaagcggauaauaaaucaucgguuuaucauaaaucgguagcaguuguuugcucacagc

SEQ ID NO: 4249294 - RNA, 81 nt, Shigella flexneri 2a str. 2457T
ugccugaugcgcuacgcuuaucaggccuacagagaugcacgaucgaguaggcgggauaaggcguuuacgccgcauccggca

SEQ ID NO: 4249295 - RNA, 73 nt, Shigella flexneri 2a str. 2457T
guaguugguggugguguacuuggcguucgggaucaagaaaccagagcgacguuugucacccaccggcaacugc

SEQ ID NO: 4249296 - RNA, 63 nt, Shigella flexneri 2a str. 2457T
gcgagccggacaaagacgaucugcuguuugaacacgacggcgcgaagcuguuugucccgcugc

SEQ ID NO: 4249297 - RNA, 71 nt, Shigella flexneri 2a str. 2457T
ucaugaugcgaagcagggcggcgguuuuccagucgccuucgcccgcaaagccguaacccugcugcaucaga

SEQ ID NO: 4249298 - RNA, 91 nt, Shigella flexneri 2a str. 2457T
cccagggcaccgugugugcaggcggucguuaugacggucuuguggaacaacugggcggucgugcaacaccggcugucgguuuugcgauggg

SEQ ID NO: 4249299 - RNA, 55 nt, Shigella flexneri 2a str. 2457T
aacgcgguuuuaagcgaaucgauggagacugcgccgacaaacuuauuaccgcguu

SEQ ID NO: 4249300 - RNA, 81 nt, Shigella flexneri 2a str. 2457T
gaaucacgccaggcuuucugcucgucgauaauccgccggaucucaggcguuaucggcaggcggaaagccuuuuguguuuuc

SEQ ID NO: 4249301 - RNA, 56 nt, Shigella flexneri 2a str. 2457T
gcggcuaaugagaggcuuuacccacauagagcuggguuaggguugucauuagucgc

SEQ ID NO: 4249302 - RNA, 60 nt, Shigella flexneri 2a str. 2457T
ugauguagguauauucgccauucuugauacgguccugaaugugcggacggccuucaugca

SEQ ID NO: 4249303 - RNA, 79 nt, Shigella flexneri 2a str. 2457T
gaccuaacugauuguuuucuacuguauagacaagcgaauaaucguuauuucucaccguauaagagaauuggcuuaaguc

SEQ ID NO: 4249304 - RNA, 59 nt, Shigella flexneri 2a str. 2457T
ucggugguguauuccgcaucgguguaaguauaagaaccgacuacguuaacacucgccga

SEQ ID NO: 4249305 - RNA, 64 nt, Shigella flexneri 2a str. 2457T
ccggcuuuaugcaauuuuuccgcgugcgggaaaagucgaugacgauggcggaauugcugaccgg

SEQ ID NO: 4249306 - RNA, 86 nt, Shigella flexneri 2a str. 2457T
guguguuguucccuuauccuggauuucagucugguuuuguugagguuaacgacaguagccagggcaaucagcaggggacaacaaac

SEQ ID NO: 4249307 - RNA, 66 nt, Shigella flexneri 2a str. 2457T
gccacuccacggugugcguuucgccagugcgugacgcgucuggcugagccgcaucgaacgugccgc

SEQ ID NO: 4249308 - RNA, 56 nt, Shigella flexneri 2a str. 2457T
cugcgacaauggcguuuuuucgacgcucucuuaugaccgaaaacgcuguucuccag

SEQ ID NO: 4249309 - RNA, 89 nt, Shigella flexneri 2a str. 2457T
gcggcgcugguggaguacaucgugcgcggcagucguuucuaccaaaccuuaauguugcugccguaugccguggcucccgccguugccgc

SEQ ID NO: 4249310 - RNA, 58 nt, Shigella flexneri 2a str. 2457T; identical to SEQ ID NO: 4227160

SEQ ID NO: 4249311 - RNA, 97 nt, Shigella flexneri 2a str. 2457T
uccagccuguguuacugccauuuucgccaaauggcaaagcccagcauaucaaaggcuuucuuaaucguuuugcgaagacggcgaaaaagacggcgga

SEQ ID NO: 4249312 - RNA, 84 nt, Shigella flexneri 2a str. 2457T
gacgcauauugcuuuuggucauuaucugcacaguaaacggugguauacugugcaggucuugucuaaaagcgaggaugcuauguc

SEQ ID NO: 4249313 - RNA, 129 nt, Shigella flexneri 2a str. 2457T
agaauuaaacaugccgguauuuaugcacugucgcgaugcccacgagcgguuuaugacauugcuggagccguggcuggauaaacugccuggugcgguucuucauugcuuuaccggcacacgcgaagagau

SEQ ID NO: 4249314 - RNA, 85 nt, Shigella flexneri 2a str. 2457T
ucugaacauaaaacacuaucaguaaguuggagucauuaccuauuuuucacagggucaauuuuuaauugagguggauauguucaga

SEQ ID NO: 4249315 - RNA, 68 nt, Shigella flexneri 2a str. 2457T
ccugccguuuacgggccugagcgcgauuucucgccacaucuccgccgccggguugcuguuaacgcugg

SEQ ID NO: 4249316 - RNA, 60 nt, Shigella flexneri 2a str. 2457T
gcguucgcgaacgucgaggaucugguuguugaucagaccuucuucgauuucgcgcagcgc

SEQ ID NO: 4249317 - RNA, 68 nt, Shigella flexneri 2a str. 2457T
uaacaguguuucggucugauauggaucagaguugaaaaacaugucugauauaaaauugaacauuguug

SEQ ID NO: 4249318 - RNA, 100 nt, Shigella flexneri 2a str. 2457T
ugccugaugcgcuacgcuuaucaggccuacaugauuucugcaauauauugaauuuggaagaauuuguaggccggauaaggcguuuacgccgcaucuggca

SEQ ID NO: 4249319 - RNA, 61 nt, Shigella flexneri 2a str. 2457T
ggugauccgauucgcguuaaugcugcauucauuugccgcaguggcguuaauugugguuauc

SEQ ID NO: 4249320 - RNA, 62 nt, Shigella flexneri 2a str. 2457T
gaugccgcagaucauuaucuggcaggagauaucgaaucccugccguuagcgacugcgacguu

SEQ ID NO: 4249321 - RNA, 130 nt, Shigella flexneri 2a str. 2457T
gaacgguaaggcggcgaggaguuuauuuuucagcgugucauuggcgcucagcggcugggcaugaaaacgcugugcuccggcacguaaggcuaacaugcugagguugugcgccagcaguucuuccagaauc

SEQ ID NO: 4249322 - RNA, 113 nt, Shigella flexneri 2a str. 2457T
aaguaacaauggaaacucaugcauuaucugacgauuguuuagauuguguauaugauugguaugcggaaaaaaauggacaauuuuuuagugcaacgaguccagaagaguuacuu

SEQ ID NO: 4249323 - RNA, 61 nt, Shigella flexneri 2a str. 2457T
uaucugugaugccagcgaugauccagauuuugguaccggucggcagcguuaucaucggaua

SEQ ID NO: 4249324 - RNA, 105 nt, Shigella flexneri 2a str. 2457T
guuuacugugcgcuguuguccaugugauauuguguaccagaugugugccaaacuauuauuucugagcguaccaaauauuauuuauggcuauaagcgacacaaaac

SEQ ID NO: 4249325 - RNA, 55 nt, Shigella flexneri 2a str. 2457T
caacaucugggugaacgggguaggcacaaauagcgcgccguucuggcggauguug

SEQ ID NO: 4249326 - RNA, 62 nt, Shigella flexneri 2a str. 2457T
cuaugauuaugaggcgaaguaucucucugaugagacacaguauuucugccccgcaggucugg

SEQ ID NO: 4249327 - RNA, 56 nt, Shigella flexneri 2a str. 2457T
cugaauugcaggaacgcuaucaccguuuccgcaacgaugaagccuuccugcaacag

SEQ ID NO: 4249328 - RNA, 56 nt, Shigella flexneri 2a str. 2457T
gccgaucgacaguggcguuauucacguuucccggaagugccgcuguuuggucgugc

SEQ ID NO: 4249329 - RNA, 58 nt, Shigella flexneri 2a str. 2457T
uccauacugaaggcgcguaucaggcgaucuacgucgauacaccgggccugcauaugga

SEQ ID NO: 4249330 - RNA, 55 nt, Shigella flexneri 2a str. 2457T; identical to SEQ ID NO: 4227409

SEQ ID NO: 4249331 - RNA, 90 nt, Shigella flexneri 2a str. 2457T
gcagauccugaagugauggauauucuggccacacugccagcggacguuuuuucuguacgagcguaucaggauaucuauacaggcaucugc

SEQ ID NO: 4249332 - RNA, 107 nt, Shigella flexneri 2a str. 2457T
acaauuagucucaauuugcaaacgcuaacugaaugcagaauaggccagacaugaaugucugguuuauucugcauuuuuuauugaauguagaauuuuauucugaaugu

SEQ ID NO: 4249333 - RNA, 87 nt, Shigella flexneri 2a str. 2457T
ugccugaugcgacacugaugcgucuuaucaggccuacaugcguuucaguuuuguaggccggacaaggcguucacgccgcauccggca

SEQ ID NO: 4249334 - RNA, 82 nt, Shigella flexneri 2a str. 2457T
uaggugcgacucgcguaauuuauccggcagggcaaaaacaagugcaacuugccgugacaaauaaugaugaaaauaguaccua

SEQ ID NO: 4249335 - RNA, 58 nt, Shigella flexneri 2a str. 2457T
cugcgagcgaagaaagugaucauugaacuuaaucacuaucacgauccgcgcguugcag

SEQ ID NO: 4249336 - RNA, 60 nt, Shigella flexneri 2a str. 2457T
cgcuguaugccaucugcgcauccaacgacguggcggugucgaugauggacggcaacagcg

SEQ ID NO: 4249337 - RNA, 70 nt, Shigella flexneri 2a str. 2457T
gcgaaugcccugauguauuugaagugaucaaagugccgguuaaaucgcauaccaaucacgggcgcaaugc

SEQ ID NO: 4249338 - RNA, 101 nt, Shigella flexneri 2a str. 2457T
ggugcaggaggugcugcgcugaugcgccaugaguuuauuuuaccuuauccgccgacggugaauacuuacuggcgacgucguggcagcacauauuuuguauc

SEQ ID NO: 4249339 - RNA, 67 nt, Shigella flexneri 2a str. 2457T
ccgguguugauguggguaaauccuucuccgguaaggacuggaaagucacagcccgcgccggccuugg

SEQ ID NO: 4249340 - RNA, 82 nt, Shigella flexneri 2a str. 2457T
guaugugcugaauuaaucugugggcgggcaaacagcauaaacgcguuugcccgcuuacugauuauugguuuacugcauauac

SEQ ID NO: 4249341 - RNA, 67 nt, Shigella flexneri 2a str. 2457T; identical to SEQ ID NO: 4228592

SEQ ID NO: 4249342 - RNA, 65 nt, Shigella flexneri 2a str. 2457T
gaagcguuggucaguaguuguugcuguucuuacauauccgggcauucuaccuuacccaacgcuuc

SEQ ID NO: 4249343 - RNA, 55 nt, Shigella flexneri 2a str. 2457T
cuuauggcucgccauccagugaaacgcuuuacguuccuggcuugccagccaugag

SEQ ID NO: 4249344 - RNA, 66 nt, Shigella flexneri 2a str. 2457T
ucacgcagacgcuguuccaguucgcuuaagcgcauccgcaacggcugaaccugcucugccagguga

SEQ ID NO: 4249345 - RNA, 59 nt, Shigella flexneri 2a str. 2457T
gcugcccuggaacuucucgucuguaaaauaauccuuacgcuacguacuucucggggcgc

SEQ ID NO: 4249346 - RNA, 97 nt, Shigella flexneri 2a str. 2457T
cccgaacgguuguggucgcgcgaugcuggcggaagugggccugguggguaaagcaccgggucgcuacaaccugcaucuuggcggcaaccgcauuggg

SEQ ID NO: 4249347 - RNA, 81 nt, Shigella flexneri 2a str. 2457T
gucugccgccagcagcagaucaccacggcugauaucgaucucauccgucagcaccagggugaucgcuucuccggcaaagac

SEQ ID NO: 4249348 - RNA, 89 nt, Shigella flexneri 2a str. 2457T
uuauauuaaguuugccgaaacgguaaaaaaugccgugcgcagcggggugcuggagcauggcaauauuuugcccggugagcgugauuuaa

SEQ ID NO: 4249349 - RNA, 107 nt, Shigella flexneri 2a str. 2457T
uugcgccuggcgguccggucgaucaggccaucgccgccauugaguuugguaaugccggaguauuacccggcgcaggcggugaagguguucgugccagccaugcgcaa

SEQ ID NO: 4249350 - RNA, 81 nt, Shigella flexneri 2a str. 2457T
uacgcccucaacagagccugucucagcaaugauuaugacaaagaaaaucacugaugagccagguucugguacgaaagcgug

SEQ ID NO: 4249351 - RNA, 75 nt, Shigella flexneri 2a str. 2457T
acgggcgacggcaggagccagcucacucgcugcgaaguaauucgugaugggcaaggcuuccuguggauagcgugu

SEQ ID NO: 4249352 - RNA, 63 nt, Shigella flexneri 2a str. 2457T; identical to SEQ ID NO: 4228312

SEQ ID NO: 4249353 - RNA, 63 nt, Shigella flexneri 2a str. 2457T
caggaacagcgcgugauguuugucagagaaaucuucugccagagcuucaaugcguuuauccug

SEQ ID NO: 4249354 - RNA, 56 nt, Shigella flexneri 2a str. 2457T
ggcgcgggaaagagaaguaauucauauuguacuguuacguucuacaaaccugugcc

SEQ ID NO: 4249355 - RNA, 75 nt, Shigella flexneri 2a str. 2457T
ugcuguuggccugcacgguaaauucgccaggacgggucauuuucgacaccugacgauacuguguugccuccagca

SEQ ID NO: 4249356 - RNA, 77 nt, Shigella flexneri 2a str. 2457T
guaggcaugauaagacgcuuccgcgucgcaucaggcauagguugccggaugcaguguaaacgucuuauccguccuac

SEQ ID NO: 4249357 - RNA, 72 nt, Shigella flexneri 2a str. 2457T
acgaugccucacccgguuaaagauauucgcguguugagccgcaucaccaccgaagccuuuaaccagcgucgu

SEQ ID NO: 4249358 - RNA, 73 nt, Shigella flexneri 2a str. 2457T; identical to SEQ ID NO: 4228515

SEQ ID NO: 4249359 - RNA, 64 nt, Shigella flexneri 2a str. 2457T
ggugacgugacgcugaccggcgacguccagcauacuggcgcgcagcagucgcgcguuaaucgcc

SEQ ID NO: 4249360 - RNA, 69 nt, Shigella flexneri 2a str. 2457T
auucuuugguguucgcaaaccaaguagaguuccaugguuuuacaauacccaagcgaauaccauuaggau

SEQ ID NO: 4249361 - RNA, 118 nt, Shigella flexneri 2a str. 2457T
cgcagcggcugguauacguggugucagcggcggacaaggauaagcacgcgucagcaguuccgccaacacugcgacagcguuguccucgcggcuuuuacccggucaaaacagcguuacg

SEQ ID NO: 4249362 - RNA, 69 nt, Shigella flexneri 2a str. 2457T
cggugaucguucaggauaagaaauuuagcgccgacgggcagauugauuaucaacuggaugugaugaccg

SEQ ID NO: 4249363 - RNA, 57 nt, Shigella flexneri 2a str. 2457T
ggcaaagugcauagcgucgcaaugggaaccgccguugccgcaggaaagcacuuugcc

SEQ ID NO: 4249364 - RNA, 79 nt, Shigella flexneri 2a str. 2457T
aaugcauaacgacgaguuuggcagaugauuucgccaauugcggauagaacgcagcgucuggaaaaccgcgaauaucauu

SEQ ID NO: 4249365 - RNA, 81 nt, Shigella flexneri 2a str. 2457T
ggcguacaguuugcgcugaugugggcaguacuggcguuuuugcucaacuacgugcccaauaucggcgcgguaauuuccgcc

SEQ ID NO: 4249366 - RNA, 79 nt, Shigella flexneri 2a str. 2457T
cggcguguucaaacaggugcugguugacucuggcguagguccggcacugggcgaagcguuaaccggcaugggccugccg

SEQ ID NO: 4249367 - RNA, 57 nt, Shigella flexneri 2a str. 2457T; identical to SEQ ID NO: 4227497

SEQ ID NO: 4249368 - RNA, 107 nt, Shigella flexneri 2a str. 2457T
uccaugcgcuggauaacgucgcggucgcuuuagcagauuuggcugaaggcacagaagucagugucgauaaccagacuguuacgcugcgccaggauguugcucgugga

SEQ ID NO: 4249369 - RNA, 73 nt, Shigella flexneri 2a str. 2457T
gcuggaaaccgguaucaaaguuaucgaccugauguguccguucgcuaagggcgguaaaguuggucuguucggu

SEQ ID NO: 4249370 - RNA, 58 nt, Shigella flexneri 2a str. 2457T
ggcuuugcugaaaucgauacggagauaguucucuuuuucguauuuggaacagcgagcc

SEQ ID NO: 4249371 - RNA, 81 nt, Shigella flexneri 2a str. 2457T
gugcacaagcucuauuacggccauuuuaugugcuaugucuuccaucaggauuacauagugaaaaaaggcguggaugugcau

SEQ ID NO: 4249372 - RNA, 76 nt, Shigella flexneri 2a str. 2457T; identical to SEQ ID NO: 4228096

SEQ ID NO: 4249373 - RNA, 81 nt, Shigella flexneri 2a str. 2457T
uguugaucgguaaauuagccgcgcgugccggaauaaacagcauuucuccuuccaccauucgcugcugcuuugcuuccagca

SEQ ID NO: 4249374 - RNA, 63 nt, Shigella flexneri 2a str. 2457T
ucagcgggaagugccacaucugucaggcaaaugugccgcaauugaguggcaucuuccugcuga

SEQ ID NO: 4249375 - RNA, 56 nt, Shigella flexneri 2a str. 2457T
uauggcaccaacgcguuacugguuggcggcggagcgguagcggguacggugcugug

SEQ ID NO: 4249376 - RNA, 69 nt, Shigella flexneri 2a str. 2457T
gccggguguccguuuaauauuccgcgccucaacaaagaggauaaccggguauauaaaugcacgcucugc

SEQ ID NO: 4249377 - RNA, 56 nt, Shigella flexneri 2a str. 2457T
guuccguuggcgauugcuugucugcugguguugcuguuaggcgcgcugaugggaac

SEQ ID NO: 4249378 - RNA, 71 nt, Shigella flexneri 2a str. 2457T
gcaaguucgccgccgucauagccggucaaugccacaauggucauaucacgcguaacggcggcuucaacugc

SEQ ID NO: 4249379 - RNA, 58 nt, Shigella flexneri 2a str. 2457T
acugcauccagaggcgaaugcaguuacguuggugggguuauuuguagaugguugcagu

SEQ ID NO: 4249380 - RNA, 58 nt, Shigella flexneri 2a str. 2457T
aaaggcguuauuauuaauugccgaacaaaauaccgagugcauuauugguagcgccuuu

SEQ ID NO: 4249381 - RNA, 58 nt, Shigella flexneri 2a str. 2457T
uuguugauuucugaggcuaauuuuugccgaaauucaauaauugccugagaaucagcaa

SEQ ID NO: 4249382 - RNA, 97 nt, Shigella flexneri 2a str. 2457T
gcuguaggagcgaacgucugguucagcagauuuggcgcaacuggcagauugugguucggguucguaguugcucugaacuugcguuucugcuuacagc

SEQ ID NO: 4249383 - RNA, 59 nt, Shigella flexneri 2a str. 2457T
guacuguucagcagauuaucaggcgcaacuugaaacggcauaaucugcguggaaaguau

SEQ ID NO: 4249384 - RNA, 73 nt, Shigella flexneri 2a str. 2457T
ggaagagggcauguucccaagccagaugucgcuggaugaaggcgggcgucuggaagaagaacgccgucuggcc

SEQ ID NO: 4249385 - RNA, 78 nt, Shigella flexneri 2a str. 2457T
ccguggaaaaaaaaucgcugcugacgguuagcuuuugcuuucgcgaugaccgcuuccgccagcgauuuuuucccaggg

SEQ ID NO: 4249386 - RNA, 67 nt, Shigella flexneri 2a str. 2457T
ugcguuuucaguugcugauucagcaucccuuuuugcuggauuugcugagucugcaucuggguuugca

SEQ ID NO: 4249387 - RNA, 68 nt, Shigella flexneri 2a str. 2457T; identical to SEQ ID NO: 4228324

SEQ ID NO: 4249388 - RNA, 76 nt, Shigella flexneri 2a str. 2457T
gcgcaaauacgugccugaaaugcgcgagaaaggugccgaugucauugucguucuggcgcauuccgggcugucugcc

SEQ ID NO: 4249389 - RNA, 128 nt, Shigella flexneri 2a str. 2457T
gccauuugcgcguaaaacaccaccuggaauagcagaucgcccaguucaccgcgaagaucgucaaaaucuucacgggcgauggcguccagcacuucguagguuucuucaaggguguaaggcgcaauggu

SEQ ID NO: 4249390 - RNA, 113 nt, Shigella flexneri 2a str. 2457T
ccucgcgcauacaaccaggcagugaugugauugucugcgcugaaauggacgaacauuggggcuacgucggugcuaaaucacgucagcgcuggcuguuuuacgcguaugacagg

SEQ ID NO: 4249391 - RNA, 130 nt, Shigella flexneri 2a str. 2457T
agcacuggcgcucggcauuggcaccaugauuggcuggcgucguguagcgaugaccaucggugagaagauugguaagcgcggcaugacguaugcgcaaggcauggcggcacaaaugacggcggcagugucu

SEQ ID NO: 4249392 - RNA, 70 nt, Shigella flexneri 2a str. 2457T
gcgcugggugaguucaccauuacgcuggacugcgacgugcuucaggcugaugguggcacucguaccgcgu

SEQ ID NO: 4249393 - RNA, 60 nt, Shigella flexneri 2a str. 2457T
ccugugguucguaauccuggcgggcgauguuaagaauauuggccccgauaauggaacagg

SEQ ID NO: 4249394 - RNA, 78 nt, Shigella flexneri 2a str. 2457T
cagugaauaacgcugaauguugaaaaugcgcgccacaucaucgcggcgcguuuccacaacguuacagcugaugcgcug

SEQ ID NO: 4249395 - RNA, 77 nt, Shigella flexneri 2a str. 2457T; identical to SEQ ID NO: 4227673

SEQ ID NO: 4249396 - RNA, 98 nt, Shigella flexneri 2a str. 2457T
gggcgaguguaagguuuacagcgauuuagaccucuaucucgguguucaggcgaucaacuggacagagauguuuaauccuggcgcgaccuucgcugucc

SEQ ID NO: 4249397 - RNA, 61 nt, Shigella flexneri 2a str. 2457T
ugcuagaacgucaucggcuacugcgugacaacaucggcaauagcuuucgcauguucucgca

SEQ ID NO: 4249398 - RNA, 67 nt, Shigella flexneri 2a str. 2457T
gccgcgauuucgguauuaccuguucgacgacgacaaacugggugucgaauaugauuaucggcgcggc

SEQ ID NO: 4249399 - RNA, 72 nt, Shigella flexneri 2a str. 2457T
cgcuggaagccuuagccgaccagguggcgaugaguccauuucaucuacaucgguuguuuaaagcuacuaccg

SEQ ID NO: 4249400 - RNA, 78 nt, Shigella flexneri 2a str. 2457T
agugcugggcgaggauuacauccgcaccgcgcgcgccaaagggcuaacccgcaugcgggugauuaucguccaugcgcu

SEQ ID NO: 4249401 - RNA, 78 nt, Shigella flexneri 2a str. 2457T
guggacacuuaaggaauugcugcccggaaagcagauagagcucuuuuucgcugccguuaauuucaaguguaaauccgc

SEQ ID NO: 4249402 - RNA, 56 nt, Shigella flexneri 2a str. 2457T
uuuugccggaugcggccuacgauuuuguagcaaucuguaggccgcauccggcagga

SEQ ID NO: 4249403 - RNA, 59 nt, Shigella flexneri 2a str. 2457T
ccgcgcacugcucgaaggcuuucggccccagacggcugacuuucagcaguugcugacgg

SEQ ID NO: 4249404 - RNA, 85 nt, Shigella flexneri 2a str. 2457T
ucacuaugcuguucaacuccaaacucucugacgauccgauuuaucgcaagcgucuggaagagggcuugguugaacugcgcgguga

SEQ ID NO: 4249405 - RNA, 56 nt, Shigella flexneri 2a str. 2457T
gguuaucgucggguaugggcgcugcuucgcagacaggcagaacuugaugguaugcc

SEQ ID NO: 4249406 - RNA, 77 nt, Shigella flexneri 2a str. 2457T
guaggccggauaaggcguucacgcugcauccggcacccggagccugaugcgacgcuggcgcgucuuaucaggccuac

SEQ ID NO: 4249407 - RNA, 87 nt, Shigella flexneri 2a str. 2457T
gguuaccgugcagcgguuaaaggcaaugugauuaaccugucucuggguuucucucauccuguugaccaucagcugccugcggguauc

SEQ ID NO: 4249408 - RNA, 62 nt, Shigella flexneri 2a str. 2457T
gcaugauugagcagaucgaaaaaguggcgauuaaaucccgcgcgccgauucugcuuaacggc

SEQ ID NO: 4249409 - RNA, 128 nt, Shigella flexneri 2a str. 2457T
gcuuucacggagcauaaaaaggguuauccaaaggucauugcaccaauauggugcuuaauguuuccauugaagcacuauauuggugcaacauucacaucauggugcagcccuuuugcacgauguuaagc

SEQ ID NO: 4249410 - RNA, 66 nt, Shigella flexneri 2a str. 2457T
ugcguuaacgcauauguucccgcugaaccgcagcacagauggcugucgggaacguccguuaaggua

SEQ ID NO: 4249411 - RNA, 70 nt, Shigella flexneri 2a str. 2457T
uugacgaucgcgguaauuauuccuugcugcgccgccuggcguagcgucaggcgcauugccugcucgucgg

SEQ ID NO: 4249412 - RNA, 88 nt, Shigella flexneri 2a str. 2457T
gaacaacaucaggcugucauugacgccauuuuugcuggugaugccgacggggcgcguaaagcaaugauggcgcaccuuaguuuuguuc

SEQ ID NO: 4249413 - RNA, 58 nt, Shigella flexneri 2a str. 2457T
gguggugccgcugcugguuuccagcucucugcuguuuuauaucggcauggcauucgcc

SEQ ID NO: 4249414 - RNA, 73 nt, Shigella flexneri 2a str. 2457T
uaguguggacagauguuguuuuaauaauuuacugcugacaguauucuuauuuuaacaacagguguuuuuauug

SEQ ID NO: 4249415 - RNA, 66 nt, Shigella flexneri 2a str. 2457T
auuacgcguugugaaguaauacaaaacaggcccaggcggccuguuuugucuuuuuaaugacuuaau

SEQ ID NO: 4249416 - RNA, 63 nt, Shigella flexneri 2a str. 2457T
ucagccuggccgagaaagauggcugguucucuaaagagccugcauuacuuucuggcgguguga

SEQ ID NO: 4249417 - RNA, 67 nt, Shigella flexneri 2a str. 2457T
cagcaugauggauguuccgguaggccguacuucugcaaaugccauuaccgguacucuguuacugcug

SEQ ID NO: 4249418 - RNA, 96 nt, Shigella flexneri 2a str. 2457T; identical to SEQ ID NO: 4228246

SEQ ID NO: 4249419 - RNA, 101 nt, Shigella flexneri 2a str. 2457T
cgcgcauacaaccgggcagugaugugauugucugcgcugaaauggacgaacauuggggcuacgucggugcuaaaucacgucagcgcugguuguuuuacgcg

SEQ ID NO: 4249420 - RNA, 129 nt, Shigella flexneri 2a str. 2457T
uaccgcacccacggcgauccgcgcgcugauggcggaaggcgauaaagcgauugaaggcaccgaccguucgucgcuacgcauucucgguuccgugggcgagccaauuaacccggaagcgugggaguggua

SEQ ID NO: 4249421 - RNA, 72 nt, Shigella flexneri 2a str. 2457T
uuggcagcguggugaugaucuucguaugugcauggcugaugcacaacguagaagucgccaaucuggugcuga

SEQ ID NO: 4249422 - RNA, 65 nt, Shigella flexneri 2a str. 2457T
augaguauuuagacuaaagaguuuguaacgcuauguaagugauuuuuucugguuuagauauuuau

SEQ ID NO: 4249423 - RNA, 104 nt, Shigella flexneri 2a str. 2457T
agcaacgcggcggugauauaacagucauacaacgcgcggugaugaugcaggcccagcggugucuguacauugagcuugcguguuuuauauaacgccauauugcu

SEQ ID NO: 4249424 - RNA, 66 nt, Shigella flexneri 2a str. 2457T
gaacauuaucaggucaugcguaccgaucagcgucgcuauuucggucacccggaucuggugauguuu

SEQ ID NO: 4249425 - RNA, 63 nt, Shigella flexneri 2a str. 2457T
cggucaccuggauccagccugcgcagaaagcgaaggcucugaauaugggguaucaggugaucg

SEQ ID NO: 4249426 - RNA, 57 nt, Shigella flexneri 2a str. 2457T
cgucacgcugguggaucagggcgggcaucuguuaacccaguccaauaccagcgggcg

SEQ ID NO: 4249427 - RNA, 63 nt, Shigella flexneri 2a str. 2457T
cgcuggugccguuguucuacgccgagaugaacaauucugcggcaaauacagcggugaccagcg

SEQ ID NO: 4249428 - RNA, 71 nt, Shigella flexneri 2a str. 2457T
gaucaucggugcugacggguugauuuuccaggaucugaacgaucugaucgacgccguucgcgcugaaaauc

SEQ ID NO: 4249429 - RNA, 88 nt, Shigella flexneri 2a str. 2457T
gcaauuuguugaauuugcagaauuuguaggccggauaaggcguuuacgccgcauccggcauauuaguuuacgccguuaacagauuagc

SEQ ID NO: 4249430 - RNA, 72 nt, Shigella flexneri 2a str. 2457T
ugguguagugugcagucggacguaccggaaucgguucuuuaaccggaucgacgccaacguacgcuuucgcca

SEQ ID NO: 4249431 - RNA, 62 nt, Shigella flexneri 2a str. 2457T
ccggucagcggaucacccaccguuuugccucugccaaacaguauguuaaucacgccugccgg

SEQ ID NO: 4249432 - RNA, 59 nt, Shigella flexneri 2a str. 2457T
ggauugggcaacugaaaugggagcuggaagauuacugcuuccguuaucuccacccgacc

SEQ ID NO: 4249433 - RNA, 77 nt, Shigella flexneri 2a str. 2457T
ccuggugacuuauauugccacgcaaaucgguuuugccaguucguggaugaacccguuuugugugguuguugcucagg

SEQ ID NO: 4249434 - RNA, 84 nt, Shigella flexneri 2a str. 2457T
gucucugcucaauggcaacaaaauccucuguugugguaauggaacuuccgcugccaaugcacagcauuuugcugccagcaugau

SEQ ID NO: 4249435 - RNA, 74 nt, Shigella flexneri 2a str. 2457T
ggcugccagaucaucguuuccgauggaagcauaauaagcuuuuucugcuucugccggagggauguggcccagcc

SEQ ID NO: 4249436 - RNA, 83 nt, Shigella flexneri 2a str. 2457T
ucaggggcuggcgcugguggcgauggucggggcgggugucacccguaacccgcugcauugccaccgcuucuggcagcaacuga

SEQ ID NO: 4249437 - RNA, 58 nt, Shigella flexneri 2a str. 2457T
gggccagaaaaucugugucuugcugaagcagagauuauggcgcggauugaugccgccc

SEQ ID NO: 4249438 - RNA, 60 nt, Shigella flexneri 2a str. 2457T
ugauagcgcggcuggucgauggugaacaguaucuguccuuuuuucaccagcugguuauca

SEQ ID NO: 4249439 - RNA, 120 nt, Shigella flexneri 2a str. 2457T
ucuguggcaugcgccugcgccgaaaaauggucaggccguuggcaccaacaccauugguucuuccgaggccuguaugcucggcgggauggcgaugaaauggcguuggcgcaagcguaugga

SEQ ID NO: 4249440 - RNA, 71 nt, Shigella flexneri 2a str. 2457T
acgaaaucguuugugaccacagucagugacuccaugugaaucagaugcugugcuaucgcuaacguggucgu

SEQ ID NO: 4249441 - RNA, 66 nt, Shigella flexneri 2a str. 2457T
agcaaaaccgaagaguaccgcggcggcaaugccaauaugcacgcgguggaagcuuucuugauuguu

SEQ ID NO: 4249442 - RNA, 59 nt, Shigella flexneri 2a str. 2457T
uuuuugcgacagaugaagagcuggcagcacaugaagcccgucucgaucuggugcagaaa

SEQ ID NO: 4249443 - RNA, 56 nt, Shigella flexneri 2a str. 2457T
uucucguugaaaaauacgcgcugguacguaccgaccagccgggauucagcgcagga

SEQ ID NO: 4249444 - RNA, 69 nt, Shigella flexneri 2a str. 2457T
cagcgugguguuggcaaucccuuguaauucuaauaauuucagggcuucucccaguacaucuucacguug

SEQ ID NO: 4249445 - RNA, 57 nt, Shigella flexneri 2a str. 2457T
agaagcugaaaucauacgguuuaccgagauaacguuuugccguuugcgucaguuuuu

SEQ ID NO: 4249446 - RNA, 65 nt, Shigella flexneri 2a str. 2457T
gguugggagucauugcaucgucaacuucaggagguagauccgguugcggcagcaaggauucaucc

SEQ ID NO: 4249447 - RNA, 84 nt, Shigella flexneri 2a str. 2457T
uaucuaauaacguugaguuuucuggaaccugucccauugaacucucgccagaaagcucaauaagacagguucuacguuuaguua

SEQ ID NO: 4249448 - RNA, 55 nt, Shigella flexneri 2a str. 2457T
ugaccauuggugcaauauaccuugauacccagggauauuacgcuggagugcguca

SEQ ID NO: 4249449 - RNA, 57 nt, Shigella flexneri 2a str. 2457T
guugagcuguuuuagcgaaacauccgggauuugcccgaguugcuguaagcguucaac

SEQ ID NO: 4249450 - RNA, 116 nt, Shigella flexneri 2a str. 2457T
cgcaaaauugccugaugcgcugcgcuuaucaggccuacagcauauaaugcaacauuuugaauuagcacgauuuuguaggccggauaaggcguuuacgccgcauccggcauuuugug

SEQ ID NO: 4249451 - RNA, 73 nt, Shigella flexneri 2a str. 2457T; identical to SEQ ID NO: 4227180

SEQ ID NO: 4249452 - RNA, 68 nt, Shigella flexneri 2a str. 2457T
cgguugccucuuccacggcuuguuugaguaugcuuugcagcucgccaagcagugggaagcgggaaccg

SEQ ID NO: 4249453 - RNA, 70 nt, Shigella flexneri 2a str. 2457T; identical to SEQ ID NO: 4228052

SEQ ID NO: 4249454 - RNA, 56 nt, Shigella flexneri 2a str. 2457T
ugggugcuguagcgccgccuggaacuguaacccugcggcggcaacuaccagaccca

SEQ ID NO: 4249455 - RNA, 59 nt, Shigella flexneri 2a str. 2457T; identical to SEQ ID NO: 4228274

SEQ ID NO: 4249456 - RNA, 66 nt, Shigella flexneri 2a str. 2457T
ggcggccuggacguugcagggcagcgugaaaaaauacgcgaugccugcaaacgucuggcagaugcc

SEQ ID NO: 4249457 - RNA, 123 nt, Shigella flexneri 2a str. 2457T
gcaaauguucguagucgaaggugaaagguucguaguaaucaucaaucugcugcggcaccaccggguuggcgaagauuuugguuauuacgcccaucuugcugcccagacgcggacggaucuugc

SEQ ID NO: 4249458 - RNA, 61 nt, Shigella flexneri 2a str. 2457T
uggagucauuaccuaagauuaagauguaauauaaaugcaucuuaaugagguggaggcagca

SEQ ID NO: 4249459 - RNA, 67 nt, Shigella flexneri 2a str. 2457T
ugauaaauuuuauccaguaaugccuggcgcucggaagguuccaggaauugcaggguaaaauucagca

SEQ ID NO: 4249460 - RNA, 81 nt, Shigella flexneri 2a str. 2457T
acgguugcugauugcuuaauuugcggcuuccugacgaugaaaaccucgccaccagaccaguaaguuaaccagggcaaucgu

SEQ ID NO: 4249461 - RNA, 55 nt, Shigella flexneri 2a str. 2457T; identical to SEQ ID NO: 4227871

SEQ ID NO: 4249462 - RNA, 58 nt, Shigella flexneri 2a str. 2457T
gucggcuaaauccgcaaugcgcgauguggugagcaaagugauugccgauuguggcugc

SEQ ID NO: 4249463 - RNA, 93 nt, Shigella flexneri 2a str. 2457T
gccgcccguuugcagguauggggagaaacucagguaagcgacgaauucguuaaucgccaguuucugcccaaucaggcuaccagcaagguuggc

SEQ ID NO: 4249464 - RNA, 71 nt, Shigella flexneri 2a str. 2457T
ugaucaggaauugcuuacuugguggauaacagaagagaacuuucaucaggucaucgaucacuuucugguua

SEQ ID NO: 4249465 - RNA, 64 nt, Shigella flexneri 2a str. 2457T
ucgaacuggagcgggcguugaguaaucaugaaaaugauaaccagcagcagcguauucaguuuga

SEQ ID NO: 4249466 - RNA, 72 nt, Shigella flexneri 2a str. 2457T
augacaccgggcgagcuggcaucauggcuugcggagaaucuucagucaugaauucacuacguccggaauuau

SEQ ID NO: 4249467 - RNA, 58 nt, Shigella flexneri 2a str. 2457T
uagcgaacugucgcugcuggaagagucgcuuaaggcccugccgugggacaguuugcug

SEQ ID NO: 4249468 - RNA, 81 nt, Shigella flexneri 2a str. 2457T
gagcccaaagcugaugucagccugauuuugcguaauccgaaagccauggacagcgcccgcaaucaggugauguuugcgcuc

SEQ ID NO: 4249469 - RNA, 71 nt, Shigella flexneri 2a str. 2457T
uggcgguuggcgcagugcgacgcuugagaaugucagcuaagcacaaucuccagcucgcgcaguucacgcca

SEQ ID NO: 4249470 - RNA, 63 nt, Shigella flexneri 2a str. 2457T
uuugcccuuuauguccgguaguagugggauuguaagaacgcauacugaccgacucagggcaga

SEQ ID NO: 4249471 - RNA, 70 nt, Shigella flexneri 2a str. 2457T
acaucucuguucgcggcuuuggugaagcggaauacugguucucacugaucaaagucacgacaguuauugu

SEQ ID NO: 4249472 - RNA, 76 nt, Shigella flexneri 2a str. 2457T; identical to SEQ ID NO: 4228271

SEQ ID NO: 4249473 - RNA, 75 nt, Shigella flexneri 2a str. 2457T
uacguagccuaaucggaggaaaaaaugucucguguugcuaaagcaccggucguuguuccugccggcguugacgua

SEQ ID NO: 4249474 - RNA, 56 nt, Shigella flexneri 2a str. 2457T
cuggcauuaggcguugcuggcuggaugcguuacgucagcggcguugaugaugccgg

SEQ ID NO: 4249475 - RNA, 75 nt, Shigella flexneri 2a str. 2457T
cguuuacagauggguaauguguugcguaugggcaacaaaacucaagccagauauaacacaaccuagcugagaacg

SEQ ID NO: 4249476 - RNA, 57 nt, Shigella flexneri 2a str. 2457T
cgucugguuaaccgcgagcaggaugaagaguucaucuuugcacugcuuaaccaugcg

SEQ ID NO: 4249477 - RNA, 72 nt, Shigella flexneri 2a str. 2457T
ggaaaccuucgguauagccacgaugcgccagaccuuccagaguuuccagcaggcugguaucgaacgguuuuc

SEQ ID NO: 4249478 - RNA, 72 nt, Shigella flexneri 2a str. 2457T
uaaccaaauuggcuuuuaccaguccauuaccgccgacggcaacuggggggaugaaaagcuaagccccgguua

SEQ ID NO: 4249479 - RNA, 67 nt, Shigella flexneri 2a str. 2457T
gggaaauggguuauaccgaaccggacccgcgagaugaucuuucugguauggauguggcgcguaaacu

SEQ ID NO: 4249480 - RNA, 61 nt, Shigella flexneri 2a str. 2457T
uugaugauaucgaucucaaccuggaagauuucguucagcgugugaaugccgauaucgugaa

SEQ ID NO: 4249481 - RNA, 55 nt, Shigella flexneri 2a str. 2457T; identical to SEQ ID NO: 4227894

SEQ ID NO: 4249482 - RNA, 69 nt, Shigella flexneri 2a str. 2457T
gaagaugauguuaagcugcuaaaugagccacguugacaucauuuggcagcuucaugcauuacaaacuuc

SEQ ID NO: 4249483 - RNA, 84 nt, Shigella flexneri 2a str. 2457T
cauuugucagccacgcgcaguugcccaaagguacgcguccacucacgcuaaauuuugaccaacagugcuggcagccugcagaug

SEQ ID NO: 4249484 - RNA, 56 nt, Shigella flexneri 2a str. 2457T
gcaggaguuggcgaugaaugaccgugacuuuaugcguuauagccgccaaauucugc

SEQ ID NO: 4249485 - RNA, 67 nt, Shigella flexneri 2a str. 2457T
guuccggcaguuauuguggcgauaccagaucagacagaguaugagccggcgcggaaacugcugggau

SEQ ID NO: 4249486 - RNA, 59 nt, Shigella flexneri 2a str. 2457T
ggcagugcguagaauuuaccuuugugcacacgagaaggcaccagguagucacgcgcgcc

SEQ ID NO: 4249487 - RNA, 59 nt, Shigella flexneri 2a str. 2457T
cggaugucuuccuguugccaucgguaacgggcgcggauggcgauauggaaggcauuccg

SEQ ID NO: 4249488 - RNA, 79 nt, Shigella flexneri 2a str. 2457T
ucagcgacgacacggugaucguuaaugugcagggugaugaaccgaugaucccugcgacaaucauucgucagguugcuga

SEQ ID NO: 4249489 - RNA, 56 nt, Shigella flexneri 2a str. 2457T
gcacauaacucauacugagcaaggcauaggcuuugcuuagcgcaaguuuauguagc

SEQ ID NO: 4249490 - RNA, 72 nt, Shigella flexneri 2a str. 2457T
gccuguacgcgcguuaacuggaaccgggugauccuugaaggucgcaaaccgggccugacgcuggguaucggc

SEQ ID NO: 4249491 - RNA, 83 nt, Shigella flexneri 2a str. 2457T
gccuggccuauguugagaugcuggcgcgugaugaaagccguuugcaggaugcgcuuaagcgucuggaugucagcccauuaggc

SEQ ID NO: 4249492 - RNA, 76 nt, Shigella flexneri 2a str. 2457T
guugccuuacgauuuuugagagccagcgcaacauguucagaaaguucgcguguuccaaaggucgcauaaggcgcgc

SEQ ID NO: 4249493 - RNA, 73 nt, Shigella flexneri 2a str. 2457T
ggcaguggcaauuggugagcuaagcguuauaucgggauggaauaagaugcggguuuuuauuauuuguuaugcc

SEQ ID NO: 4249494 - RNA, 124 nt, Shigella flexneri 2a str. 2457T
gaauacuguuagccccgcuaaacgaauaucccaguaauagcgcguugaucccuucaucccaacguucaggggggacauaaccacgggcauuacuuuugauggcgauuugcgguacugaaauuuc

SEQ ID NO: 4249495 - RNA, 67 nt, Shigella flexneri 2a str. 2457T
cuguauccacugugcgccagccuucaccccgcagugcgggcaggagcggcuuuuacaccggaagcag

SEQ ID NO: 4249496 - RNA, 61 nt, Shigella flexneri 2a str. 2457T
gccgaacggauaaagcgcuccguuagcuucaucaaaauaacgcgaaguauauuuguucggc

SEQ ID NO: 4249497 - RNA, 74 nt, Shigella flexneri 2a str. 2457T
ggcgcauauagaacgcuuuaauaucuuucggauaguuuuuaaccacuaccggugcuuuaaaguguucuuccgcc

SEQ ID NO: 4249498 - RNA, 58 nt, Shigella flexneri 2a str. 2457T
gucgagaaaacgggauagcaccgugaauaauaaugcgcguguucguuccuuuucugac

SEQ ID NO: 4249499 - RNA, 83 nt, Shigella flexneri 2a str. 2457T
gccuuuggcggcgguuucgaacuggcgcuggcggcagauuuuauuguuugugccgauaacgccagcuucgcccugccggaagc

SEQ ID NO: 4249500 - RNA, 61 nt, Shigella flexneri 2a str. 2457T
gcuggaaagcaccugcgcggcggcuucggcagcaucuucguccgcgguguuuucagccagc

SEQ ID NO: 4249501 - RNA, 60 nt, Shigella flexneri 2a str. 2457T
uguucaguuuugacgaugcgcuugccggucguuuacuggcgagugccucacaagagaacg

SEQ ID NO: 4249502 - RNA, 55 nt, Shigella flexneri 2a str. 2457T
gcgaugggcaaaaagcaucugauuggcagccgucgcgauugcuuagugccugcgc

SEQ ID NO: 4249503 - RNA, 79 nt, Shigella flexneri 2a str. 2457T
cggcgaaguuggacgcugauuuucugcgcccagcauggugggaauugaugggccguagauaucggcguccagaaugccg

SEQ ID NO: 4249504 - RNA, 64 nt, Shigella flexneri 2a str. 2457T
cuuuccaagcgucgaucccgcucgguggcgcguccgcgccagauggcgauggcgcuagcgaaag

SEQ ID NO: 4249505 - RNA, 85 nt, Shigella flexneri 2a str. 2457T
gucagagagccggucaaucgcauucuggggcaugugaaaaaugucauucugaucgauccccaggaguauuuaccguuugucuggc

SEQ ID NO: 4249506 - RNA, 58 nt, Shigella flexneri 2a str. 2457T
gcgucaugcagucacgguugaacauacacuuaacaauggaaccgaccugcgcugacgc

SEQ ID NO: 4249507 - RNA, 58 nt, Shigella flexneri 2a str. 2457T
ggugacuguacuggaaggucugcugcgccucgcgcauccgaucauuccguucaucacc

SEQ ID NO: 4249508 - RNA, 63 nt, Shigella flexneri 2a str. 2457T
cuuaucaggccuacauagucccugcaauagauugaauuagcaaggguuuguaggccggauaag

SEQ ID NO: 4249509 - RNA, 70 nt, Shigella flexneri 2a str. 2457T
ggccguugagauccuuuacaacgcuuuucgcgaaggaacgcggauuauuguggucggugauuucgacgcc

SEQ ID NO: 4249510 - RNA, 57 nt, Shigella flexneri 2a str. 2457T; identical to SEQ ID NO: 4227958

SEQ ID NO: 4249511 - RNA, 58 nt, Shigella flexneri 2a str. 2457T; identical to SEQ ID NO: 4228110

SEQ ID NO: 4249512 - RNA, 68 nt, Shigella flexneri 2a str. 2457T
guaacgcgaguauccagauuagugaccugauuguucagguuaguaaugcucuggguauuuugcgcuac

SEQ ID NO: 4249513 - RNA, 117 nt, Shigella flexneri 2a str. 2457T
ucgaugcaaaccgcaagugguggguauuuaucgucugauuaugaagagcgggucagauaacuuccgugcgucuucuauucaggggauuaugaagcguaucaaggcgaaaggcguuga

SEQ ID NO: 4249514 - RNA, 57 nt, Shigella flexneri 2a str. 2457T
ucagaaguaaucccucauucccgcuguggcccacagcgggaacaucguuaccucuga

SEQ ID NO: 4249515 - RNA, 59 nt, Shigella flexneri 2a str. 2457T
cuccgccggaagagagauugcgguacguuccaguucgcaagugacaucuuuuggcagag

SEQ ID NO: 4249516 - RNA, 95 nt, Shigella flexneri 2a str. 2457T
gccccuggcuggcauuccggggcauuuugacggcgcgcuggaugugaaucugcaacagcccguuauguacgaaggccuggagccggaucaggggc

SEQ ID NO: 4249517 - RNA, 88 nt, Shigella flexneri 2a str. 2457T
uggcgagcauguugagaaguagugacgugauaaucgcuggaaucuucagucgguuccgcguuaucaguccauuuguuuucuuccgcca

SEQ ID NO: 4249518 - RNA, 61 nt, Shigella flexneri 2a str. 2457T
uuauccggccuacauaaucacgcaaauucaauauauugcagagaucauguaggccggauaa

SEQ ID NO: 4249519 - RNA, 73 nt, Shigella flexneri 2a str. 2457T
gugguguuucucgguuugcuggucacgaucuacuccacggguuaucugacggauaaaaaucgcgaacacccgc

SEQ ID NO: 4249520 - RNA, 62 nt, Shigella flexneri 2a str. 2457T
cagugugaccuucaguagccagcagcagcgccugaacuggcuggucaacgaagguuacuaug

SEQ ID NO: 4249521 - RNA, 68 nt, Shigella flexneri 2a str. 2457T
uacucgccgugcggugauugaacguaguaucgcgcaggcgaugcaacauuugucgccgcaggagagua

SEQ ID NO: 4249522 - RNA, 92 nt, Shigella flexneri 2a str. 2457T
gggcugguguuugguaucguugggcugguguugcuacugguucaggcgguggaucucaaugccagcgccacagcgauaaccaguuacagccu

SEQ ID NO: 4249523 - RNA, 73 nt, Shigella flexneri 2a str. 2457T
ucggaaggcuguaaucaccgcugcaccuucugcauuauuccgucuaugcgcggcgaccugaugagccguccga

SEQ ID NO: 4249524 - RNA, 72 nt, Shigella flexneri 2a str. 2457T
uuccagccaggcagcaagugcagcucgcuggcuguuggcuagauccgggcugauuugcugaugugccuggaa

SEQ ID NO: 4249525 - RNA, 66 nt, Shigella flexneri 2a str. 2457T
cugggcggucguuucccggaaggcuauccggucgcgguugucucuuccguaaaacucgauacccag

SEQ ID NO: 4249526 - RNA, 86 nt, Shigella flexneri 2a str. 2457T
cgaugucuuuuuuggcgauagugauguggaacgagucgaucucucuuaucacgagaguuuacaacgcauuguuaaaggcgaugucg

SEQ ID NO: 4249527 - RNA, 62 nt, Shigella flexneri 2a str. 2457T
aagguuuucccugagcaaauuugccagacagaguaauccagcaaaucguccggggaaaccuu

SEQ ID NO: 4249528 - RNA, 72 nt, Shigella flexneri 2a str. 2457T
uuuuugcccgcuaagcaggcgcauuaccgcuucgguaguccgcuggcguagcgucugauuagcggaaagaaa

SEQ ID NO: 4249529 - RNA, 60 nt, Shigella flexneri 2a str. 2457T
gugggcacaaaaaauggcguugaccauaaagccuccuuagccgcgcguuuugccgcccgc

SEQ ID NO: 4249530 - RNA, 71 nt, Shigella flexneri 2a str. 2457T
gaaucuuuucaggcaaaugccaguaaaaacugcuucauagcgcggauuuuuacuggcguuugccuagaguc

SEQ ID NO: 4249531 - RNA, 90 nt, Shigella flexneri 2a str. 2457T
guacuugccgaagagaugucauuacugaugcuggacagccgccgggugauccaaagcauucaguugaugaaaucgcugggcggcggguau

SEQ ID NO: 4249532 - RNA, 77 nt, Shigella flexneri 2a str. 2457T
uuucccuucguuguaauauuucagggugugaucaucauaaucgaucaagucacugacaucguuacgauauccggaaa

SEQ ID NO: 4249533 - RNA, 67 nt, Shigella flexneri 2a str. 2457T
gcgcgccaguuggcgaucuacagaacccggacgcuucaucaguuugagaaugcgcgggcuggcgugc

SEQ ID NO: 4249534 - RNA, 60 nt, Shigella flexneri 2a str. 2457T
cagcgucagcguauugcuaucgcucgagccuugcugcgugauagcccgauucugauucug

SEQ ID NO: 4249535 - RNA, 68 nt, Shigella flexneri 2a str. 2457T
gcugacgcaaauugguuauguucccaacaucgcgcaaagcgaugcgacauuacaggguuugcgucagc

SEQ ID NO: 4249536 - RNA, 73 nt, Shigella flexneri 2a str. 2457T
gcagcagcgaugcaggcacaccgcuaugaucugcaauaucagcuuuauacccuggcgcugcaucguuaucugc

SEQ ID NO: 4249537 - RNA, 60 nt, Shigella flexneri 2a str. 2457T
gugucgaugauaugcagcggcauuccgucaauguggauaugcucacgcagcacgucacgc

SEQ ID NO: 4249538 - RNA, 58 nt, Shigella flexneri 2a str. 2457T
gaauuuuuuccgcaaucuucgcccgcugaccagcgaguuugagauuguugaagaauuc

SEQ ID NO: 4249539 - RNA, 74 nt, Shigella flexneri 2a str. 2457T
auugucguuucacuccaaccuguucaagcuacggaauugaggcauugcgcagguuuggagugauaaaaggcagu

SEQ ID NO: 4249540 - RNA, 66 nt, Shigella flexneri 2a str. 2457T
ugaugacgcugcggcaguucgcgacuccacgguaacaacguuuuagccagcugcugcgcaucaaca

SEQ ID NO: 4249541 - RNA, 60 nt, Shigella flexneri 2a str. 2457T
gugguuacauuguuaucgucccugcgagcucccggugauugggaugauacuauguaucac

SEQ ID NO: 4249542 - RNA, 59 nt, Shigella flexneri 2a str. 2457T
cggauaaagcguguugcauuuggacacccuugccggaugcggcguaaaugccuuauccg

SEQ ID NO: 4249543 - RNA, 56 nt, Shigella flexneri 2a str. 2457T; identical to SEQ ID NO: 4228102

SEQ ID NO: 4249544 - RNA, 67 nt, Shigella flexneri 2a str. 2457T
aucgcugacaggagcgcuccagccccuucgauggcugaaucgaacagccgagcgacuucugcacggu

SEQ ID NO: 4249545 - RNA, 74 nt, Shigella flexneri 2a str. 2457T
uaauguacuuggcugguuaaguacguagcggcuaaauacuugccagacuacgcauacaaccagagcaagcauua

SEQ ID NO: 4249546 - RNA, 56 nt, Shigella flexneri 2a str. 2457T
gcccuuuguaggccagauaagacgcgucagcgucgcaucuggcauaaacaaagcgc

SEQ ID NO: 4249547 - RNA, 77 nt, Shigella flexneri 2a str. 2457T
gcggcgcgaugccgcuuacucaagaagaaagaauuaugacguugucuccuuauuugaaagagguggcgaagcgccgc

SEQ ID NO: 4249548 - RNA, 69 nt, Shigella flexneri 2a str. 2457T
gcaacaaggcauggaagggagcguuaaagcgggcaggcauuagcaacuuccgcuuccaugaccugaggc

SEQ ID NO: 4249549 - RNA, 59 nt, Shigella flexneri 2a str. 2457T; identical to SEQ ID NO: 4227744

SEQ ID NO: 4249550 - RNA, 60 nt, Shigella flexneri 2a str. 2457T
cgguacuacaggcacguugcgcuugcugagaacggaaagcgacaucuugccuguggaucg

SEQ ID NO: 4249551 - RNA, 67 nt, Shigella flexneri 2a str. 2457T
ggugagcuguaauuucccgcguuuguuauaagcgagguuguaauagucggugaauuucggcuuaacc

SEQ ID NO: 4249552 - RNA, 63 nt, Shigella flexneri 2a str. 2457T
aguacacgcaucccgcccaccagcgcagucauuuccggcgcggucagcgucaguugcugugcu

SEQ ID NO: 4249553 - RNA, 96 nt, Shigella flexneri 2a str. 2457T; identical to SEQ ID NO: 4227671

SEQ ID NO: 4249554 - RNA, 71 nt, Shigella flexneri 2a str. 2457T; identical to SEQ ID NO: 4227486

SEQ ID NO: 4249555 - RNA, 64 nt, Shigella flexneri 2a str. 2457T
gguaaugcuggcagucacuggugggcuggcaguaaugugcuucgucaaaauguacgguauuacu

SEQ ID NO: 4249556 - RNA, 56 nt, Shigella flexneri 2a str. 2457T
cuguugcaggaaggcuucaucguugcggaaacggugauagcguuccugcaauucag

SEQ ID NO: 4249557 - RNA, 86 nt, Shigella flexneri 2a str. 2457T
ugcggcgugccaccaugauaccuuguuccgacagcaaagagguuaacuugcugucgcucaacgguuucgcuggguuuuccgccgcg

SEQ ID NO: 4249558 - RNA, 69 nt, Shigella flexneri 2a str. 2457T
uggcaacgcuauccuuuugucaccaugauuuccgucgagcggaaagguuagaaugauagcuuuguguca

SEQ ID NO: 4249559 - RNA, 55 nt, Shigella flexneri 2a str. 2457T
ucaggccuacaaaaucuugcaaauucaauauauugcaaucuccguguaggccuga

SEQ ID NO: 4249560 - RNA, 63 nt, Shigella flexneri 2a str. 2457T
uugccgcguuuucgacgagguucaucgcaaauguuguuuuacccaucgacggacgcgcggcga

SEQ ID NO: 4249561 - RNA, 70 nt, Shigella flexneri 2a str. 2457T
aaggccggugucauuugaugugacugacagacgauauucaccguuacccacguuaaugaugcucgcacuu

SEQ ID NO: 4249562 - RNA, 106 nt, Shigella flexneri 2a str. 2457T
cgagaucgcauuugguuugaaacugcaaaaaugcccggcggaugaaaucacucaacguacccaugcugcccugcaauguugucaguuagcagacacugccaacucg

SEQ ID NO: 4249563 - RNA, 72 nt, Shigella flexneri 2a str. 2457T
gcaguaucaaaacgucgggcaauagccugaagguuuuuauccccuucuugcaccguauacguuugauuuugc

SEQ ID NO: 4249564 - RNA, 88 nt, Shigella flexneri 2a str. 2457T
gugacaacagcguacccguugacuguuugucaaagaaugaaacuggcauucccaucaugugaccaaacaggcggcgacgcauggucau

SEQ ID NO: 4249565 - RNA, 58 nt, Shigella flexneri 2a str. 2457T
uugcucagcuggucaacuuuagcguucagagucugaacgucagaagacagcugaucga

SEQ ID NO: 4249566 - RNA, 76 nt, Shigella flexneri 2a str. 2457T
cauggugcggauuuacgcguggugcagaugcuacugggccacagcgaucuuuccaccacgcaaauuuauacgcaug

SEQ ID NO: 4249567 - RNA, 62 nt, Shigella flexneri 2a str. 2457T
cugcgagaauggcguaucggagcggugauguaucgcugguuccugcgccauuucccacgcgg

SEQ ID NO: 4249568 - RNA, 81 nt, Shigella flexneri 2a str. 2457T; identical to SEQ ID NO: 4227615

SEQ ID NO: 4249569 - RNA, 55 nt, Shigella flexneri 2a str. 2457T
gugaguuugguuaaucacgauggguauuuucuccauugcuaaccaacauauucgc

SEQ ID NO: 4249570 - RNA, 69 nt, Shigella flexneri 2a str. 2457T
gugucgcggguagcaggguguucucguuacgcagcugcuuuucgaucucaucuugcuggcgcgcgauau

SEQ ID NO: 4249571 - RNA, 71 nt, Shigella flexneri 2a str. 2457T; identical to SEQ ID NO: 4227861

SEQ ID NO: 4249572 - RNA, 99 nt, Shigella flexneri 2a str. 2457T
gccugucuguuugcccaacguuugcagguagagcagauuauugccgucagcaaugaaacgcauauuuaccgcagccugcguuaucgcgauaaagaaggc

SEQ ID NO: 4249573 - RNA, 80 nt, Shigella flexneri 2a str. 2457T
gcgagaacauggcaucccaggaacugccgugauguugguuauaucggucaucuugcuuuucuuggucaacaaaguuccgc

SEQ ID NO: 4249574 - RNA, 65 nt, Shigella flexneri 2a str. 2457T
cccgaccgauuucguaacgcggcugcgcgaugguugucagcggcggaucacaaaauugcgucagg

SEQ ID NO: 4249575 - RNA, 69 nt, Shigella flexneri 2a str. 2457T
ugcucaaauccgcguucaaggauuuccagauugguaagaacuucagauuccuugacguaauuuggcgca

SEQ ID NO: 4249576 - RNA, 92 nt, Shigella flexneri 2a str. 2457T
cugccagaauauuugugaguuuaucuucuacuacgugaagggucaggauuuccgucauguaggcggugaugagcuggauaaacugcuggcgg

SEQ ID NO: 4249577 - RNA, 81 nt, Shigella flexneri 2a str. 2457T
uuggcguaagcaauuuagcgcucgacacccugggaguaggcgacuccucccagguaguggucagcggcuauguauugccag

SEQ ID NO: 4249578 - RNA, 62 nt, Shigella flexneri 2a str. 2457T
cauggugcgcuggguaucagaaauggcagacaaacuccguccucuguauauagcgcugaaug

SEQ ID NO: 4249579 - RNA, 78 nt, Shigella flexneri 2a str. 2457T
cccugggaaaaaaucgcuggcggaagcggucaucgcgaaagcaaaagcuaaccgucagcagcgauuuuuuuuccacgg

SEQ ID NO: 4249580 - RNA, 93 nt, Shigella flexneri 2a str. 2457T
agaucggaacguuuguaauagcacaugacaaaaaugcccuggucaucguccacaauguuauuguuuaguguuauuuuuugacuuuccagaacu

SEQ ID NO: 4249581 - RNA, 86 nt, Shigella flexneri 2a str. 2457T
acaaccgggcagugaugugauugucugcgcugaaauggacgaacauuggggcuacgucggugcuaaaucacgucagcgcuggcugu

SEQ ID NO: 4249582 - RNA, 103 nt, Shigella flexneri 2a str. 2457T
uugccugaugcgcuacgcuuaucaggccuacaucgugcauugaaauugaauggauuugcaaugaacuguaggccggauaaggcguuuacgccgcauccggcaa

SEQ ID NO: 4249583 - RNA, 99 nt, Shigella flexneri 2a str. 2457T
ugucgguuguagagcguaucugggaucgucuuaccgcguucgacagcgcuacugucggcgcggcgcagcuggucuacaaggcgcauuugcguaccuaca

SEQ ID NO: 4249584 - RNA, 80 nt, Shigella flexneri 2a str. 2457T
guagaagccaguuugaucagaauacgaucguugcuaauaccugcaucguuguagaguuugaucaggcguuuugcuuucgc

SEQ ID NO: 4249585 - RNA, 113 nt, Shigella flexneri 2a str. 2457T
ccucgcgcauacaacugggcagugaugugauugucugcgcugaaauggacgaacauuggggcuacgucggugcuaaaucacgucagcgcuggcuguuuuacgcguaugacagg

SEQ ID NO: 4249586 - RNA, 70 nt, Shigella flexneri 2a str. 2457T; identical to SEQ ID NO: 4227890

SEQ ID NO: 4249587 - RNA, 62 nt, Shigella flexneri 2a str. 2457T
aucaugagaaagaguaucuggugacggucgauaaaccgauuaccgaugaauuuauucguggu

SEQ ID NO: 4249588 - RNA, 72 nt, Shigella flexneri 2a str. 2457T
guggauaugagcaacggcgaugaagugucgaucaccuguggugaagcggcgagcauuguugaucguauucgc

SEQ ID NO: 4249589 - RNA, 97 nt, Shigella flexneri 2a str. 2457T
cuugcugaucaacuggcagcgcugggggagagcgaucuguuguuugcccucucgcaacacgcgguugcuuuugcccaaucacagcugcaucagcaag

SEQ ID NO: 4249590 - RNA, 60 nt, Shigella flexneri 2a str. 2457T
gguauggucgcaugguuagcagggccagaagccaguuuuguuaccggcgcgaugcauacc

SEQ ID NO: 4249591 - RNA, 105 nt, Shigella flexneri 2a str. 2457T
uccauacugcaugaugcuggagcguguuacugaauaccugacggcgauugaagauuucacccgucuggauuuaguacgucgcugcuucuauuuaaaagugugcga

SEQ ID NO: 4249592 - RNA, 78 nt, Shigella flexneri 2a str. 2457T
guaaggugacagugauugaacuggcggcaaccgucaugggccguaaugcaccaccgcccgugcaacgcuaucuuuuac

SEQ ID NO: 4249593 - RNA, 74 nt, Shigella flexneri 2a str. 2457T
gaauuucauugcuuucuucuguuccuggaucuauuuauuuguucugggcuuauggaaaaaagcaauuauaguuc

SEQ ID NO: 4249594 - RNA, 81 nt, Shigella flexneri 2a str. 2457T
uuggccguacgcucuccaacgccauguugucgcuaggaauuuacgaagauguacagggcgcacuggaagcgaugggguuaa

SEQ ID NO: 4249595 - RNA, 107 nt, Shigella flexneri 2a str. 2457T
gcgauaauuucuuuuucauagcgauaaaauacgguuuaugaaaauagggaaacguuuguguugcaacauaaauuguaugacauauuaacugugaugauauuugucgc

SEQ ID NO: 4249596 - RNA, 56 nt, Shigella flexneri 2a str. 2457T; identical to SEQ ID NO: 4227854

SEQ ID NO: 4249597 - RNA, 82 nt, Shigella flexneri 2a str. 2457T
gccgggcuggaugucggugccgaugacuaucuggugaagccuuuugcgcuggaagaguuacacgcccguauccgcgcccugc

SEQ ID NO: 4249598 - RNA, 79 nt, Shigella flexneri 2a str. 2457T
acgucaaaaacaaagucauggaguucguuggaccgggcguuagcgcgcucucuaccgauuuccguaacagcguugacgu

SEQ ID NO: 4249599 - RNA, 56 nt, Shigella flexneri 2a str. 2457T
cgagcacggcuugcgcugcuucagaguauuuugugaaguaguuccgcuugugcacg

SEQ ID NO: 4249600 - RNA, 129 nt, Shigella flexneri 2a str. 2457T
uuccugccaugcugauggccucgcaagggcagaaaauggcagcgauguuccauaaucagggcaacccgguuuuugauuaugucuggaacacggugcgucgucgcuuuggcggucgucugcaugcgagaa

SEQ ID NO: 4249601 - RNA, 59 nt, Shigella flexneri 2a str. 2457T
guaauuuuugagauaaaaaugccagccgaucgggcuggcauuuugccuuuaggauguac

SEQ ID NO: 4249602 - RNA, 75 nt, Shigella flexneri 2a str. 2457T
ucgucgguacggcaggcgaggcggaucauacacucuaucagagcaaaaugaccggacgccuggcgcuggugaugg

SEQ ID NO: 4249603 - RNA, 68 nt, Shigella flexneri 2a str. 2457T
gcuucgcugggaaaucccugggccauccagcuuucugcggcggcacgguggauuuccggcagcuccgc

SEQ ID NO: 4249604 - RNA, 55 nt, Shigella flexneri 2a str. 2457T
ggccgguaaaucuucacucuguaaugcacuguuucagggggaggucacaccgguc

SEQ ID NO: 4249605 - RNA, 71 nt, Shigella flexneri 2a str. 2457T
ccaggauccaauggcaguagauaaacuggcggaagguauccguaaguuugcuauugaccaggaaaaacugg

SEQ ID NO: 4249606 - RNA, 112 nt, Shigella flexneri 2a str. 2457T
uccuggcgaaagauuacggcguagguucugacguuuauagcgugaccuccuucaccgagcuggcgcgugauggucaggauugugaacgcuggaacaugcugcauccgcugga

SEQ ID NO: 4249607 - RNA, 129 nt, Shigella flexneri 2a str. 2457T
auccggcaguuaugcgcagaugccugaugcgacgcuggcgcgucuuaucaugccuaaaaacuugugccugaacgguaggccggauaaggcguuuacgccgcauccggcaauugugcaccgaugccggau

SEQ ID NO: 4249608 - RNA, 84 nt, Shigella flexneri 2a str. 2457T
uuggucauaaucacucaucaauaaauauuauaguaagauguccccggaggauauggaauaauauuaauugaggugaaugaccag

SEQ ID NO: 4249609 - RNA, 91 nt, Shigella flexneri 2a str. 2457T
cgauaaguugaaggugguguuccugccggauuauugcguuucggcggcggaaaaacugaucccggcggcggauaucuccgaacaaauuucg

SEQ ID NO: 4249610 - RNA, 58 nt, Shigella flexneri 2a str. 2457T
ggcuguuuuucaucgguguuggcaugucgauagacuuuggcacgcugauugaaaaccc

SEQ ID NO: 4249611 - RNA, 79 nt, Shigella flexneri 2a str. 2457T
cggggcuaaaggcagaaguaugaaauuucgggugagccacuuucguagcucacccguuagcacuaucugaaccgccccg

SEQ ID NO: 4249612 - RNA, 94 nt, Shigella flexneri 2a str. 2457T
gucccggggagcugccgacaggguggcugugcgaugcgcuggaucagauauuuaucgccgcaccacaacugucagcaguggcucuccccugggc

SEQ ID NO: 4249613 - RNA, 58 nt, Shigella flexneri 2a str. 2457T
augucguucggcgagguggugauauugguaaauuccaccugcauuuccgaacgcacgu

SEQ ID NO: 4249614 - RNA, 76 nt, Shigella flexneri 2a str. 2457T
cgcgacggucuauggcuuccugaaacaguuuggucuggaaaaagagauuaaacugaacauugaagcuaaccacgcg

SEQ ID NO: 4249615 - RNA, 95 nt, Shigella flexneri 2a str. 2457T
gguucagguuauuaccggugaucaacauccacuuaucaucaacccacaucccuuucaggugauagguguugucgucaucuuuccauaaccgaacc

SEQ ID NO: 4249616 - RNA, 72 nt, Shigella flexneri 2a str. 2457T
aaaggccaucaucgcagucauaaagucggcauaagcaaucuuccacgauccaugugcugccccguggcuuuu

SEQ ID NO: 4249617 - RNA, 91 nt, Shigella flexneri 2a str. 2457T
cgguuaaucugcugguucgcggaauguguucgcugauccccaaucuggaaggcauuagcgacaacauucgugccaucaguauuguugaccg

SEQ ID NO: 4249618 - RNA, 61 nt, Shigella flexneri 2a str. 2457T
caggcgguagcagcgaccauucugaacgugacugaagaucauauggaucgcuacccguuug

SEQ ID NO: 4249619 - RNA, 81 nt, Shigella flexneri 2a str. 2457T
cauucaaucguguugauguucgucgcccgucgcuggcgcugaccgccaacagcagcacggugaauaucagcgaacugagug

SEQ ID NO: 4249620 - RNA, 129 nt, Shigella flexneri 2a str. 2457T; identical to SEQ ID NO: 4227515

SEQ ID NO: 4249621 - RNA, 55 nt, Shigella flexneri 2a str. 2457T
aagcgguuugcgccaggugagcuucaauuuugcucauaauggcgucagcacguuu

SEQ ID NO: 4249622 - RNA, 83 nt, Shigella flexneri 2a str. 2457T; identical to SEQ ID NO: 4227256

SEQ ID NO: 4249623 - RNA, 108 nt, Shigella flexneri 2a str. 2457T
gcggcacggcuggcggugaguggugacggcgguauacaucgcggugaaagaggauuuauacacuuucaccugaucgucgccguacugcucgcgcgccugcgguuccgu

SEQ ID NO: 4249624 - RNA, 64 nt, Shigella flexneri 2a str. 2457T
auuggcaucugguacaacaauuucuuuggugcggaaacugaagcgauucugccguaugaccagu

SEQ ID NO: 4249625 - RNA, 56 nt, Shigella flexneri 2a str. 2457T
ugcugaugaagaaggucauaucgacuggcucgaaacugaacuggaucucaucggua

SEQ ID NO: 4249626 - RNA, 59 nt, Shigella flexneri 2a str. 2457T
ggaacuguucgccgugcaaaucuuccagcaccgucagauugaugcgcgagcgacguucc

SEQ ID NO: 4249627 - RNA, 72 nt, Shigella flexneri 2a str. 2457T
ggauuuauugguuuuugguacugcgucauuucgaagaaaccgaugacgcauacguggcagggaaucagauuc

SEQ ID NO: 4249628 - RNA, 61 nt, Shigella flexneri 2a str. 2457T; identical to SEQ ID NO: 4228511

SEQ ID NO: 4249629 - RNA, 65 nt, Shigella flexneri 2a str. 2457T
accauuaccuuuaacggacugucgaaaacguaccgcguugcaggcuuccgucagggguggauggu

SEQ ID NO: 4249630 - RNA, 97 nt, Shigella flexneri 2a str. 2457T; identical to SEQ ID NO: 4227694

SEQ ID NO: 4249631 - RNA, 56 nt, Shigella flexneri 2a str. 2457T
ggcagugccuucagcauggaagaacgccguaacuucaaccugcugggguuacugcc

SEQ ID NO: 4249632 - RNA, 76 nt, Shigella flexneri 2a str. 2457T
aaccucguguauuguguauuuacuguuggguucgaaggauucgacaucuugcaauaaauauuucaguucugcgguu

SEQ ID NO: 4249633 - RNA, 68 nt, Shigella flexneri 2a str. 2457T
guuuugaaagcgcauuuguagccagggcagcuccugaagcagcucuugcucuugacgcucuucauaac

SEQ ID NO: 4249634 - RNA, 72 nt, Shigella flexneri 2a str. 2457T
cguuccgcgaccguggcagguugggcauucguuacacaguacgugcucaaugcuuucgcgggugcguuuacg

SEQ ID NO: 4249635 - RNA, 59 nt, Shigella flexneri 2a str. 2457T; identical to SEQ ID NO: 4228509

SEQ ID NO: 4249636 - RNA, 85 nt, Shigella flexneri 2a str. 2457T
gcgcugauuccagguguuaucgauauuggugaguuuaucggucaggguuuugaccugauuuuccagaucuggcacacgggagcgc

SEQ ID NO: 4249637 - RNA, 55 nt, Shigella flexneri 2a str. 2457T
cccuucaucgagugcgcggccggguaacagauuuaccgucaccgaugcagaaggg

SEQ ID NO: 4249638 - RNA, 87 nt, Shigella flexneri 2a str. 2457T
ugguacagcgccccggcuuuccaguucaccagauugcccgacuuggcggugucgacgguggugacuggagaaccuuuugccacacca

SEQ ID NO: 4249639 - RNA, 57 nt, Shigella flexneri 2a str. 2457T
ggcacugaaaccguggguguuaccggacugacgguggcaccggcaucugucaguguc

SEQ ID NO: 4249640 - RNA, 60 nt, Shigella flexneri 2a str. 2457T
uugcucgacagaagccgugaagagagccgccgugagcguucucugcgucgucuggagcaa

SEQ ID NO: 4249641 - RNA, 56 nt, Shigella flexneri 2a str. 2457T
uggugcggauuuacgcguggugcagaugcuacugggccacagcgaucuuuccacca

SEQ ID NO: 4249642 - RNA, 57 nt, Shigella flexneri 2a str. 2457T
gaugcaaugaaaguaccguucuacuucggugggaccucacugcuuaucguuguuguc

SEQ ID NO: 4249643 - RNA, 59 nt, Shigella flexneri 2a str. 2457T
ucgccaugaucccaccgcacaugcagaaaucauggcccugcggcaggguggucugguga

SEQ ID NO: 4249644 - RNA, 67 nt, Shigella flexneri 2a str. 2457T
cggauaaucguuugcaugaugcagccucccuaaaaaaguggcuccaucguggcggauuauugugacg

SEQ ID NO: 4249645 - RNA, 63 nt, Shigella flexneri 2a str. 2457T
aguggcaacgcugcguugaagcgauugaaaauaucgacaacauucagccuggcgucgcccacu

SEQ ID NO: 4249646 - RNA, 79 nt, Shigella flexneri 2a str. 2457T
uugaugaauguccggagccauuaaagucuguuguugaauuugcacuggcaacaggcuuaagacgcucgaacaucaucaa

SEQ ID NO: 4249647 - RNA, 72 nt, Shigella flexneri 2a str. 2457T
gcguugauccgcaugauaucccgcagguggcguuuauugaugcugacaugauggaugguaugccuccggcgc

SEQ ID NO: 4249648 - RNA, 68 nt, Shigella flexneri 2a str. 2457T
cguuaccuugcucuucauucaggccuuuaacugcaccugcgauaaucccgauugaagagaaguuagcg

SEQ ID NO: 4249649 - RNA, 82 nt, Shigella flexneri 2a str. 2457T
gcguugaaagggaugguuuuugagcaacagcguuuaaguuuugacgaauugcugucgguauuaaaagccaacuuugcaacgc

SEQ ID NO: 4249650 - RNA, 83 nt, Shigella flexneri 2a str. 2457T
agcagcacuucgauaccuugugcacgcaguucgcuguacaguuucucagcaagcucuuguacgcggaaggauuugugcauguu

SEQ ID NO: 4249651 - RNA, 64 nt, Shigella flexneri 2a str. 2457T
ccgggcguccugcuugccagauacgauguuguagcaucuuauccagcaaccaggucgcauccgg

SEQ ID NO: 4249652 - RNA, 63 nt, Shigella flexneri 2a str. 2457T
aaccggauacaucuuguuccaugcguugaacagcugcguuugcuggcgagagagugucagguu

SEQ ID NO: 4249653 - RNA, 86 nt, Shigella flexneri 2a str. 2457T
cuauccgcuggaucacgaguuuaucaccgguggcgaauaucgucguaucugcacgcugggugagaaacugcguggcuugcuggaag

SEQ ID NO: 4249654 - RNA, 84 nt, Shigella flexneri 2a str. 2457T
gcauggacgagauguucgcuucgguuaaaaaaaggcaccuuacgaggugccucugauaauuagcuaagugcauguuguucaugu

SEQ ID NO: 4249655 - RNA, 62 nt, Shigella flexneri 2a str. 2457T
cggcucugcucuucaucgaccuagcaacuguuaccguugcaagugaaaaagagcggcauccg

SEQ ID NO: 4249656 - RNA, 81 nt, Shigella flexneri 2a str. 2457T
guggaugacagcaguaucgacuacacccugccgcuggcaggcgaguauccggugagcagugcaguggugcucuguuuucgc

SEQ ID NO: 4249657 - RNA, 100 nt, Shigella flexneri 2a str. 2457T
guccagcguuuuuugcaaguaaacagugauuugcggugacggauaauacugcgucgccgccugauuaacguuuuuguacaccauauaacagacgcugggc

SEQ ID NO: 4249658 - RNA, 96 nt, Shigella flexneri 2a str. 2457T
uccgggagagcaaacggcgaaguauaucgauaaaguaaugacccgccugaccuugguuggugcgcuguauauuaccuuuaucugccugaucccgga

SEQ ID NO: 4249659 - RNA, 90 nt, Shigella flexneri 2a str. 2457T
gccaucucugaaaauaugguaaucaacaauggccgcgcuaaugucugggcuggcacaaugguuaacgugucagucagagggaaugauggc

SEQ ID NO: 4249660 - RNA, 92 nt, Shigella flexneri 2a str. 2457T
cugugaacucaggcugccagaucaucguuuccgauggaagcauaauaagcuuuuucugcuucugccggagggauguggcccagccuuuccag

SEQ ID NO: 4249661 - RNA, 99 nt, Shigella flexneri 2a str. 2457T
agcguuguggccggaaccgaugacgcgccugaaugcgauggggaugccgucuaucgccauguggaugcagugcggguugguuacugucuucauucugcu

SEQ ID NO: 4249662 - RNA, 73 nt, Shigella flexneri 2a str. 2457T
agacgaguuacaucaacaaacuccgacgccuugcucaacgggagccggacuuuauugauauacacgcucaucu

SEQ ID NO: 4249663 - RNA, 56 nt, Shigella flexneri 2a str. 2457T
gauugaugaccugagcuucucgaucccgaaaggggcgaucgucgggaucaucgguc

SEQ ID NO: 4249664 - RNA, 69 nt, Shigella flexneri 2a str. 2457T
aaguaauggaagguguuaaacuggaaaaccgcacucacgcgccaguugauuuugacaccgcuguugcuu

SEQ ID NO: 4249665 - RNA, 91 nt, Shigella flexneri 2a str. 2457T
aggcauccauacccguugcggcggucagugacuucggcauaccaaucaucagagaggagucauugacagaaagcagcggagucacgugcuu

SEQ ID NO: 4249666 - RNA, 58 nt, Shigella flexneri 2a str. 2457T
ggauaucacgcugauuuacgccggaucgcacaagguggauggcaaucaguuugaaucc

SEQ ID NO: 4249667 - RNA, 61 nt, Shigella flexneri 2a str. 2457T
ccuguugcgcuccugucaugugcauugcuucauauaaucacuggcgcaaggagcgcgcagg

SEQ ID NO: 4249668 - RNA, 68 nt, Shigella flexneri 2a str. 2457T
gucgauugcaggcgcgacuggaagcguuagggauuaaaaccuuacuuugcgauccgccucgcgccgac

SEQ ID NO: 4249669 - RNA, 63 nt, Shigella flexneri 2a str. 2457T; identical to SEQ ID NO: 4228035

SEQ ID NO: 4249670 - RNA, 87 nt, Shigella flexneri 2a str. 2457T; identical to SEQ ID NO: 4227293

SEQ ID NO: 4249671 - RNA, 62 nt, Shigella flexneri 2a str. 2457T
acuuccugcuguaaagucgguugcaaugguaccgcgaggacuucacuuuuacgccaggaagu

SEQ ID NO: 4249672 - RNA, 68 nt, Shigella flexneri 2a str. 2457T
gcugaagaagugugguuuuguagauauccgcauuguggaugugugcguuaccacuacugaagagcagc

SEQ ID NO: 4249673 - RNA, 62 nt, Shigella flexneri 2a str. 2457T
uccuggguuguaucguuuauuccgcgccgcccggagcggagcgaaacggcacaaccaucgga

SEQ ID NO: 4249674 - RNA, 59 nt, Shigella flexneri 2a str. 2457T
accgucaggguacggaauguacggucuccuucagaacuaauacggcuguuucugacggu

SEQ ID NO: 4249675 - RNA, 73 nt, Shigella flexneri 2a str. 2457T
ucggcauauuuacguucggcgagcaguuguuccaguugauacaggaacagccacuggugagcgguguugccga

SEQ ID NO: 4249676 - RNA, 62 nt, Shigella flexneri 2a str. 2457T
cgccacuuucuucugcgguuccugugcggugauucgucguaagccgcuggaugaaauuggcg

SEQ ID NO: 4249677 - RNA, 73 nt, Shigella flexneri 2a str. 2457T
ggcagugaugugauugucugcgcugaaauggacgaacauuggggcuacgucggugcuaaaucacgucagcgcu

SEQ ID NO: 4249678 - RNA, 80 nt, Shigella flexneri 2a str. 2457T
guaaacggcucugcgucauuccggaguuuaugaggcacuaaggcgaacauaagagauggaaugagcaucuacucguuuau

SEQ ID NO: 4249679 - RNA, 75 nt, Shigella flexneri 2a str. 2457T
guugaguacgugcguucggaaaugcagguggaauuuaccaauaucaccaccucgccgaacgacauugugguuaac

SEQ ID NO: 4249680 - RNA, 101 nt, Shigella flexneri 2a str. 2457T
ugcugcaauuuacugauuucuuugguucuuguaggccggauaaggcguuuacgccgcauccggcaugaagcaacguauucgauauuagcaauuuggcggca

SEQ ID NO: 4249681 - RNA, 92 nt, Shigella flexneri 2a str. 2457T
cggauguuucagccgauacgcggcuguuucauuuuuuagcgcgugacuacauugugcaggaagggcaacagccgucauggcuguuuuaucug

SEQ ID NO: 4249682 - RNA, 76 nt, Shigella flexneri 2a str. 2457T
uguuaaacgcagcuccgggcucaugcuguccagguuauuaaauaaccagcgcagauagcccggauagcguucggca

SEQ ID NO: 4249683 - RNA, 62 nt, Shigella flexneri 2a str. 2457T
ugcaggcguagcgcguaaaccggguauggaucguuccgaccuguuuaacguuaacgccggca

SEQ ID NO: 4249684 - RNA, 85 nt, Shigella flexneri 2a str. 2457T
ucgguuaucuggcguauuucuaucuucuauuugugcucuauuuuugucgucguggcauuaauaccguggaauaugccggggcuga

SEQ ID NO: 4249685 - RNA, 55 nt, Shigella flexneri 2a str. 2457T
cugggcugacaccguacaggaggcaaaaaucuggcuuucaucggcguuagcccag

SEQ ID NO: 4249686 - RNA, 74 nt, Shigella flexneri 2a str. 2457T; identical to SEQ ID NO: 4227792

SEQ ID NO: 4249687 - RNA, 56 nt, Shigella flexneri 2a str. 2457T
cgagguugucuuucagaucgcagugaccaacggugacgcgcgaaagaucaacuccg

SEQ ID NO: 4249688 - RNA, 71 nt, Shigella flexneri 2a str. 2457T
cuuaacgccauuugcgccauugauuguccacgcugcugugccauuucauucaauaagcgcaggcuguugag

SEQ ID NO: 4249689 - RNA, 73 nt, Shigella flexneri 2a str. 2457T
cccacgggcaggcgagugaaacauagagaugauaacgaucuuucucugcgauaaaaccgccugugccaguggg

SEQ ID NO: 4249690 - RNA, 70 nt, Shigella flexneri 2a str. 2457T; identical to SEQ ID NO: 4227128

SEQ ID NO: 4249691 - RNA, 79 nt, Shigella flexneri 2a str. 2457T; identical to SEQ ID NO: 4228444

SEQ ID NO: 4249692 - RNA, 65 nt, Shigella flexneri 2a str. 2457T
uaucaaaacguugcugaugggugacgauccgaguucggucgaucucuauuccgacguugaugaua

SEQ ID NO: 4249693 - RNA, 63 nt, Shigella flexneri 2a str. 2457T
gcuguuuuaucaugguugcagaaguccuuauccuuauucacucugcuggcuugaugaauuugc

SEQ ID NO: 4249694 - RNA, 59 nt, Shigella flexneri 2a str. 2457T
uuaauacagucuugccugaugcgacgcuggcgcgucuuaucaggcuugggcaguguuag

SEQ ID NO: 4249695 - RNA, 68 nt, Shigella flexneri 2a str. 2457T
gccggcauucugcguauuuaucuuuugcaauuuucugccauugugggguauaaaacgcggcgcgcggc

SEQ ID NO: 4249696 - RNA, 65 nt, Shigella flexneri 2a str. 2457T
ggcaucgcgggccugucgguggcgacggacucccugucugccaucaaauaugcccgcgugaaacc

SEQ ID NO: 4249697 - RNA, 91 nt, Shigella flexneri 2a str. 2457T
gcagguucgaaucuuugaguaucgcagauagcaaaaaagcgccuuuagggcgcuuuuuuacauuggugggucgugcaggauucgaaccugc

SEQ ID NO: 4249698 - RNA, 65 nt, Shigella flexneri 2a str. 2457T
gagcuugaugaugagcgucgcggguugcuugccagccgcuuaaaagcgacgcaaucacaggucuu

SEQ ID NO: 4249699 - RNA, 129 nt, Shigella flexneri 2a str. 2457T
guugaugcgaugcggcucauacugcuuagccauaccagaccagaaugcaguagucgcagcggaagugaugguaauaccacguuccugcuccugcuccauccaguccaugguugcagcgccgucaugaac

SEQ ID NO: 4249700 - RNA, 59 nt, Shigella flexneri 2a str. 2457T
cuggcgggggagaaugaagguaucgaucacaaggugauagaugcguuuucacccgcugg

SEQ ID NO: 4249701 - RNA, 68 nt, Shigella flexneri 2a str. 2457T
guauaagcgucccguuucgaucuuaguggucaucuaugcacaagauacgaaacgggugcugauguugc

SEQ ID NO: 4249702 - RNA, 59 nt, Shigella flexneri 2a str. 2457T
guagucgccgauaccgagguagcgggucagcucgcccagcgcuucgguauggcgggugc

SEQ ID NO: 4249703 - RNA, 59 nt, Shigella flexneri 2a str. 2457T
gccguuuucccugguggucagggcgguccguugaugcacguaaucgccgguaaagcggu

SEQ ID NO: 4249704 - RNA, 82 nt, Shigella flexneri 2a str. 2457T
cgcguugggguaaccguauugauggcaacgcacgacauuaaucugauuucacggcguuccuaucgcaugcucacccugagcg

SEQ ID NO: 4249705 - RNA, 67 nt, Shigella flexneri 2a str. 2457T
uuaacaacggagaacaguauccuguggaugagcugaucagcauagauucucguuguccguugcuuga

SEQ ID NO: 4249706 - RNA, 80 nt, Shigella flexneri 2a str. 2457T
gcagaucaucguaaccgacgacgguuuacagcauuaccgucuggcgcgugauguggaaauugucguuauugauggugugc

SEQ ID NO: 4249707 - RNA, 119 nt, Shigella flexneri 2a str. 2457T
ucacgcguucucuaucgaaucugauagcggcguugaacuguucguccacuucgguaucgacaccguugaacugaaaggcgaaggcuucaagcguauugcugaagaaggucagcgcguga

SEQ ID NO: 4249708 - RNA, 56 nt, Shigella flexneri 2a str. 2457T
agcagacaacccacacauuucucgguauuacaaugcggugugcggguuuucucgcu

SEQ ID NO: 4249709 - RNA, 72 nt, Shigella flexneri 2a str. 2457T
cggcggguucuugaucaacaccugcggauugccaucuuccgcaauccggccuuugucgauaaagaucagccg

SEQ ID NO: 4249710 - RNA, 61 nt, Shigella flexneri 2a str. 2457T; identical to SEQ ID NO: 4228196

SEQ ID NO: 4249711 - RNA, 76 nt, Shigella flexneri 2a str. 2457T
aggcugccagaucaucguuuccgauggaagcauaauaagcuuuuucugcuucugccggagggauguggcccagccu

SEQ ID NO: 4249712 - RNA, 62 nt, Shigella flexneri 2a str. 2457T; identical to SEQ ID NO: 4228010

SEQ ID NO: 4249713 - RNA, 64 nt, Shigella flexneri 2a str. 2457T
cgacgcagcagagcaaggaguugugaucaagccugcacaaaauuccaccguugcuguugcgucg

SEQ ID NO: 4249714 - RNA, 74 nt, Shigella flexneri 2a str. 2457T
uguugacccggagcgccuuaucuugccugaugcgcguaacgcaucaggcaauuuggcguuugcccuuagucaca

SEQ ID NO: 4249715 - RNA, 69 nt, Shigella flexneri 2a str. 2457T
gcguauuaucaacggcgaagugccggaaggauugaaaggccgccgcguacuggcgcuggauaugggcgc

SEQ ID NO: 4249716 - RNA, 59 nt, Shigella flexneri 2a str. 2457T
ugucguuaucaauugcuccgguaccacuuuuaaauggcacaggaguuuccgguaauaca

SEQ ID NO: 4249717 - RNA, 85 nt, Shigella flexneri 2a str. 2457T
gaaauuaugccaaagcgguuguacccgugccgguguugaugcucccauugauaucggccgcuuacagcguuuuguuacugauuuu

SEQ ID NO: 4249718 - RNA, 98 nt, Shigella flexneri 2a str. 2457T
gguaagcacgaccacacuggcaauugccagccacgguauaaaccagccacagauuugauacagccguggugggaucgccaguugaugcaguguuuucc

SEQ ID NO: 4249719 - RNA, 58 nt, Shigella flexneri 2a str. 301; identical to SEQ ID NO: 4249191

SEQ ID NO: 4249720 - RNA, 88 nt, Shigella flexneri 2a str. 301
gcccgaugcgcuacgcuuaucaggccuacgugauuccugcaauuuauugaauuuguaggccggauugggcguuuacgccgcauccggc

SEQ ID NO: 4249721 - RNA, 66 nt, Shigella flexneri 2a str. 301; identical to SEQ ID NO: 4248758

SEQ ID NO: 4249722 - RNA, 90 nt, Shigella flexneri 2a str. 301; identical to SEQ ID NO: 4249021

SEQ ID NO: 4249723 - RNA, 74 nt, Shigella flexneri 2a str. 301
uucuuuuugcccgcuaagcaggcgcauuaccgcuucgguaguccgcuggcguagcgucugauuagcggaaagaa

SEQ ID NO: 4249724 - RNA, 103 nt, Shigella flexneri 2a str. 301
uaucugggcuguuuaccgggagcugcucuaucgcagcaugaaauucgugucugcgcggaauuucuggcggcauggugccagcaacggcugggcaagcccgaug

SEQ ID NO: 4249725 - RNA, 59 nt, Shigella flexneri 2a str. 301
gcagcaggugcaucgccagcauuucgaaccucgucaggugcaggucagcacguugcugu

SEQ ID NO: 4249726 - RNA, 66 nt, Shigella flexneri 2a str. 301
gcgcauucaggcguucuuccaucaguuguggagaaccgcgauaugcuucgauugccuggacagcgu

SEQ ID NO: 4249727 - RNA, 64 nt, Shigella flexneri 2a str. 301
gacucugugauggcaguaauuuuucugauaaugauggcagaggagcauacugccgcgcgguauc

SEQ ID NO: 4249728 - RNA, 62 nt, Shigella flexneri 2a str. 301; identical to SEQ ID NO: 4248972

SEQ ID NO: 4249729 - RNA, 72 nt, Shigella flexneri 2a str. 301
cagcgccguauguugauuauuaccggcccgaacaugggcgguaaaaguaccuauaugcgccagaccgcacug

SEQ ID NO: 4249730 - RNA, 107 nt, Shigella flexneri 2a str. 301; identical to SEQ ID NO: 4249332

SEQ ID NO: 4249731 - RNA, 67 nt, Shigella flexneri 2a str. 301
guaaagcuugucgaguugacgggcggcaucauaugaauuccgcccgaaugugucaacggcaaauugc

SEQ ID NO: 4249732 - RNA, 82 nt, Shigella flexneri 2a str. 301; identical to SEQ ID NO: 4248856

SEQ ID NO: 4249733 - RNA, 63 nt, Shigella flexneri 2a str. 301; identical to SEQ ID NO: 4249244

SEQ ID NO: 4249734 - RNA, 58 nt, Shigella flexneri 2a str. 301
uugugcauaguuacaacuuugaaacguuauauaugucaaguuguuaaaaugugcacag

SEQ ID NO: 4249735 - RNA, 128 nt, Shigella flexneri 2a str. 301; identical to SEQ ID NO: 4249409

SEQ ID NO: 4249736 - RNA, 81 nt, Shigella flexneri 2a str. 301; identical to SEQ ID NO: 4249577

SEQ ID NO: 4249737 - RNA, 58 nt, Shigella flexneri 2a str. 301; identical to SEQ ID NO: 4249498

SEQ ID NO: 4249738 - RNA, 105 nt, Shigella flexneri 2a str. 301; identical to SEQ ID NO: 4249127

SEQ ID NO: 4249739 - RNA, 85 nt, Shigella flexneri 2a str. 301
gccugaugcgacacugaugcgucuuaucaggccuacaugcguuucaguuuuguaggccggacaaggcguucacgccgcauccggc

SEQ ID NO: 4249740 - RNA, 56 nt, Shigella flexneri 2a str. 301
gggcaaaauauucgccgucgcggugaagauaucucugcaggugcgguuguuuuccc

SEQ ID NO: 4249741 - RNA, 109 nt, Shigella flexneri 2a str. 301
ccggaguagcuggcuuuuccugacgguauagcaucgcucaucaugaugucgcuuccggcaaugcgcacguuggcaugagcgauggcgguaucgggaaauugcauuccgg

SEQ ID NO: 4249742 - RNA, 91 nt, Shigella flexneri 2a str. 301
cgcgcuuuuucuagucggugaggugugggggcuucuguuuugucgucgcucucgucagacacgucgccaauccuggaaagaguauuaagcg

SEQ ID NO: 4249743 - RNA, 57 nt, Shigella flexneri 2a str. 301; identical to SEQ ID NO: 4249186

SEQ ID NO: 4249744 - RNA, 58 nt, Shigella flexneri 2a str. 301; identical to SEQ ID NO: 4227901

SEQ ID NO: 4249745 - RNA, 55 nt, Shigella flexneri 2a str. 301; identical to SEQ ID NO: 4248846

SEQ ID NO: 4249746 - RNA, 73 nt, Shigella flexneri 2a str. 301; identical to SEQ ID NO: 4249295

SEQ ID NO: 4249747 - RNA, 91 nt, Shigella flexneri 2a str. 301; identical to SEQ ID NO: 4249005

SEQ ID NO: 4249748 - RNA, 130 nt, Shigella flexneri 2a str. 301
cuacgucuguuugaagaguuuaaccgcguugggguaaccguauugauggcaacgcacgacauuaaucugauuucacggcguuccuaucgcaugcucacccugagcgauggucacuugcauggaggcgugg

SEQ ID NO: 4249749 - RNA, 75 nt, Shigella flexneri 2a str. 301; identical to SEQ ID NO: 4249355

SEQ ID NO: 4249750 - RNA, 97 nt, Shigella flexneri 2a str. 301; identical to SEQ ID NO: 4228584

SEQ ID NO: 4249751 - RNA, 63 nt, Shigella flexneri 2a str. 301
aucgaauggauuuugugaugucagaugcugcugccugaaccaauccagauccagauauucggu

SEQ ID NO: 4249752 - RNA, 59 nt, Shigella flexneri 2a str. 301; identical to SEQ ID NO: 4249432

SEQ ID NO: 4249753 - RNA, 56 nt, Shigella flexneri 2a str. 301
accaaccagcugcgcuucgacuuugaguauaugaacccgaugccaggcgguucggu

SEQ ID NO: 4249754 - RNA, 59 nt, Shigella flexneri 2a str. 301; identical to SEQ ID NO: 4228509

SEQ ID NO: 4249755 - RNA, 67 nt, Shigella flexneri 2a str. 301
cugauuuugcucagucucgccgcaucugguuaaguuauuccgaaguuggcgaugauggcaaagccgg

SEQ ID NO: 4249756 - RNA, 70 nt, Shigella flexneri 2a str. 301
aucagccgcguuaucgcuuaguugaacugcaccgcaaacgcguugccaacggugagcguagcgugcuggu

SEQ ID NO: 4249757 - RNA, 79 nt, Shigella flexneri 2a str. 301
gucgcuuucuggcgacacuuaaaugauugauuuuauuguaaucuaauaaguuuaucuuaaguugucucuuuuuagcgac

SEQ ID NO: 4249758 - RNA, 99 nt, Shigella flexneri 2a str. 301
auucuguuuguggugguguuucucgguuugcuggucacgaucuacuccacggguuaucugacggauaaaaaucgcgaacacccgcauaacggcacgaau

SEQ ID NO: 4249759 - RNA, 84 nt, Shigella flexneri 2a str. 301; identical to SEQ ID NO: 4249608

SEQ ID NO: 4249760 - RNA, 77 nt, Shigella flexneri 2a str. 301; identical to SEQ ID NO: 4249237

SEQ ID NO: 4249761 - RNA, 130 nt, Shigella flexneri 2a str. 301; identical to SEQ ID NO: 4227208

SEQ ID NO: 4249762 - RNA, 96 nt, Shigella flexneri 2a str. 301; identical to SEQ ID NO: 4228246

SEQ ID NO: 4249763 - RNA, 72 nt, Shigella flexneri 2a str. 301
gauaauaccguuacgcugcggugccagguaggugacuucgaaaccuucgcgcuccagcugacggcaaguauc

SEQ ID NO: 4249764 - RNA, 58 nt, Shigella flexneri 2a str. 301; identical to SEQ ID NO: 4249381

SEQ ID NO: 4249765 - RNA, 56 nt, Shigella flexneri 2a str. 301
ucaauucuuggcugcucauugguccaucuuuuugccugagaagcuggaaggguuga

SEQ ID NO: 4249766 - RNA, 79 nt, Shigella flexneri 2a str. 301; identical to SEQ ID NO: 4249503

SEQ ID NO: 4249767 - RNA, 60 nt, Shigella flexneri 2a str. 301; identical to SEQ ID NO: 4249316

SEQ ID NO: 4249768 - RNA, 66 nt, Shigella flexneri 2a str. 301; identical to SEQ ID NO: 4249041

SEQ ID NO: 4249769 - RNA, 57 nt, Shigella flexneri 2a str. 301; identical to SEQ ID NO: 4249221

SEQ ID NO: 4249770 - RNA, 81 nt, Shigella flexneri 2a str. 301
aaccgcauucgcuucaugcagggcuuuacgaaugauuucuggauaguguucauaaggcuggugcgcggagagcaugucguu

SEQ ID NO: 4249771 - RNA, 63 nt, Shigella flexneri 2a str. 301; identical to SEQ ID NO: 4228312

SEQ ID NO: 4249772 - RNA, 62 nt, Shigella flexneri 2a str. 301
uaaagugaugguagucacauaaagucaccuuccagcuaauaagugugaccgccgucauauua

SEQ ID NO: 4249773 - RNA, 129 nt, Shigella flexneri 2a str. 301; identical to SEQ ID NO: 4249420

SEQ ID NO: 4249774 - RNA, 63 nt, Shigella flexneri 2a str. 301
cgccgcgauaaggggcggcaauuuuccgguugccacguaauucugcuucgcuaucgcuuugcg

SEQ ID NO: 4249775 - RNA, 57 nt, Shigella flexneri 2a str. 301
ccaucgccuguacgaugcgcucgcgcggugugacguagugcguuuucggguagaugg

SEQ ID NO: 4249776 - RNA, 70 nt, Shigella flexneri 2a str. 301
gcuuucccggcgaucacggcaugaugcugcuuauuuuuucggcauucauguggcguuauuucggcaaagu

SEQ ID NO: 4249777 - RNA, 99 nt, Shigella flexneri 2a str. 301; identical to SEQ ID NO: 4249194

SEQ ID NO: 4249778 - RNA, 60 nt, Shigella flexneri 2a str. 301
ccgggcgagcuggcaucauggcuugcggagaaucuucagucaugaauucacuacguccgg

SEQ ID NO: 4249779 - RNA, 56 nt, Shigella flexneri 2a str. 301; identical to SEQ ID NO: 4227649

SEQ ID NO: 4249780 - RNA, 88 nt, Shigella flexneri 2a str. 301
gcgaugccugcuuccgccaccgcucaucgcccggaacuugccgggcgcaguuucgaggcgaugggcguuucacugguagugcauccgc

SEQ ID NO: 4249781 - RNA, 93 nt, Shigella flexneri 2a str. 301; identical to SEQ ID NO: 4249463

SEQ ID NO: 4249782 - RNA, 75 nt, Shigella flexneri 2a str. 301; identical to SEQ ID NO: 4249351

SEQ ID NO: 4249783 - RNA, 64 nt, Shigella flexneri 2a str. 301
ccgagaagaagugaacauuacugcgcacgccgcguuuuucugccagugccucaaauuuucgcgg

SEQ ID NO: 4249784 - RNA, 61 nt, Shigella flexneri 2a str. 301
uuuaugcugcugacuacucuucgucgucgccaucgacaugcgcacgaaucagcgccauaaa

SEQ ID NO: 4249785 - RNA, 65 nt, Shigella flexneri 2a str. 301
cguaucaggcaaaauaugucggaugcggcgugaaugccuuauccgaugguuuagccuguauuacg

SEQ ID NO: 4249786 - RNA, 92 nt, Shigella flexneri 2a str. 301; identical to SEQ ID NO: 4248956

SEQ ID NO: 4249787 - RNA, 96 nt, Shigella flexneri 2a str. 301
cucuacuuuucagguaauuuauucccauaaacucagauuuacugcugcuucacgcaggaucugaguuuaugggaaugcucaaccuggaagccggag

SEQ ID NO: 4249788 - RNA, 69 nt, Shigella flexneri 2a str. 301; identical to SEQ ID NO: 4248816

SEQ ID NO: 4249789 - RNA, 63 nt, Shigella flexneri 2a str. 301
uuuggcuucagcguuuugcaggaaaccacgcaucugauggaaaaccugcucgaugaagccaga

SEQ ID NO: 4249790 - RNA, 71 nt, Shigella flexneri 2a str. 301
uuaucgugagucacaucagcguccgcuggugauugugcacggcggcgguugcgugguggaugagcugauga

SEQ ID NO: 4249791 - RNA, 58 nt, Shigella flexneri 2a str. 301
ucgccgaugucagauaaaaccuguugaaacucaagguaauuaucaugaucgauggcgg

SEQ ID NO: 4249792 - RNA, 130 nt, Shigella flexneri 2a str. 301; identical to SEQ ID NO: 4249391

SEQ ID NO: 4249793 - RNA, 63 nt, Shigella flexneri 2a str. 301
gcugcaccaggaacgauccuugaagccaacaaacaaggcauucagguugcgacuggugauggc

SEQ ID NO: 4249794 - RNA, 80 nt, Shigella flexneri 2a str. 301
aaguggcuggggaaaauggacgcaacgucgcugaaaaacaaaguagcagcgucgauuguggcaauuucuuccauucacuu

SEQ ID NO: 4249795 - RNA, 73 nt, Shigella flexneri 2a str. 301; identical to SEQ ID NO: 4249199

SEQ ID NO: 4249796 - RNA, 62 nt, Shigella flexneri 2a str. 301
cugugcguauggaacuccaggccgacuguuuugccggugucugggggcauaguaugcagcag

SEQ ID NO: 4249797 - RNA, 58 nt, Shigella flexneri 2a str. 301
uucguaggcgcucugaacuugcguuucugcuuacagcguagccucagcuccuuacgaa

SEQ ID NO: 4249798 - RNA, 91 nt, Shigella flexneri 2a str. 301
aaggcugauugaugaauguccggagccauuaaagucuguuguugaauuugcacuggcaacaggcuuaagacgcucgaacaucaucaaccuu

SEQ ID NO: 4249799 - RNA, 64 nt, Shigella flexneri 2a str. 301
cgagaucuggcugaggugaaacaauuucacauggcaacaggugaugaucacuacaccgaucucg

SEQ ID NO: 4249800 - RNA, 113 nt, Shigella flexneri 2a str. 301; identical to SEQ ID NO: 4249125

SEQ ID NO: 4249801 - RNA, 91 nt, Shigella flexneri 2a str. 301
cagcgguggugguaaaaguacccugcugcaccugcuggccggucuggaaacgccaaccgcaggcgauguguuagcgggcaccacaccgcug

SEQ ID NO: 4249802 - RNA, 59 nt, Shigella flexneri 2a str. 301; identical to SEQ ID NO: 4227507

SEQ ID NO: 4249803 - RNA, 83 nt, Shigella flexneri 2a str. 301; identical to SEQ ID NO: 4249491

SEQ ID NO: 4249804 - RNA, 129 nt, Shigella flexneri 2a str. 301
ccagcguucugccugugccgucuacugcucaucaguugcugaugcgcugccaggcguuacuuauucaacugcuccauaacggcuggcgcuaucaggaacagagcgcuauuaaucaggcagaguugcugg

SEQ ID NO: 4249805 - RNA, 68 nt, Shigella flexneri 2a str. 301; identical to SEQ ID NO: 4248885

SEQ ID NO: 4249806 - RNA, 89 nt, Shigella flexneri 2a str. 301; identical to SEQ ID NO: 4249262

SEQ ID NO: 4249807 - RNA, 67 nt, Shigella flexneri 2a str. 301
ucaacagagccugucucagcaaugauuaugacaaagaaaaucacugaugagccagguucugguacga

SEQ ID NO: 4249808 - RNA, 73 nt, Shigella flexneri 2a str. 301; identical to SEQ ID NO: 4249675

SEQ ID NO: 4249809 - RNA, 75 nt, Shigella flexneri 2a str. 301
uacgcgauacggcgauuuuuucucuggggcagcccauuuuuugcagccuuccggcccacagaucgcuuaucggua

SEQ ID NO: 4249810 - RNA, 70 nt, Shigella flexneri 2a str. 301; identical to SEQ ID NO: 4248891

SEQ ID NO: 4249811 - RNA, 62 nt, Shigella flexneri 2a str. 301; identical to SEQ ID NO: 4249276

SEQ ID NO: 4249812 - RNA, 84 nt, Shigella flexneri 2a str. 301; identical to SEQ ID NO: 4248838

SEQ ID NO: 4249813 - RNA, 68 nt, Shigella flexneri 2a str. 301; identical to SEQ ID NO: 4249111

SEQ ID NO: 4249814 - RNA, 59 nt, Shigella flexneri 2a str. 301
ugaugucaggacacggggcuuguagugaaagcgcauuacgguaacgucguucuacuuca

SEQ ID NO: 4249815 - RNA, 56 nt, Shigella flexneri 2a str. 301
cggcggaucaguuacaggcguucgaugaaacgauccucgccagugggaucgugccg

SEQ ID NO: 4249816 - RNA, 80 nt, Shigella flexneri 2a str. 301
cggcgaguaucauccugaugcugguauuggugauucugaccaugcuggcggcagucacgaccgguucaggcaaugcgccg

SEQ ID NO: 4249817 - RNA, 67 nt, Shigella flexneri 2a str. 301; identical to SEQ ID NO: 4249479

SEQ ID NO: 4249818 - RNA, 80 nt, Shigella flexneri 2a str. 301; identical to SEQ ID NO: 4249060

SEQ ID NO: 4249819 - RNA, 57 nt, Shigella flexneri 2a str. 301
cggcuuguucagaagccuucgcaggcucuugcgccugaacgauuucuucuacaaccg

SEQ ID NO: 4249820 - RNA, 96 nt, Shigella flexneri 2a str. 301
ggaacgauguacaacuggaagauucucugggaauggaaguggguuaucgacugaucccgauggucgauuuccagcaggauggugaguuguugggcc

SEQ ID NO: 4249821 - RNA, 66 nt, Shigella flexneri 2a str. 301; identical to SEQ ID NO: 4249066

SEQ ID NO: 4249822 - RNA, 58 nt, Shigella flexneri 2a str. 301
uuuguugccacugcacauggugaaagacuuuaccuuccgccugccaguaggcaaugaa

SEQ ID NO: 4249823 - RNA, 75 nt, Shigella flexneri 2a str. 301; identical to SEQ ID NO: 4248780

SEQ ID NO: 4249824 - RNA, 64 nt, Shigella flexneri 2a str. 301
gcugggugauuucgcgaccuucccggugauuaugucacuggcaggucuggcggugaucaucggc

SEQ ID NO: 4249825 - RNA, 71 nt, Shigella flexneri 2a str. 301; identical to SEQ ID NO: 4249261

SEQ ID NO: 4249826 - RNA, 120 nt, Shigella flexneri 2a str. 301
gcgggcguaccaacugcugugaaaaaauuucagucauuggcgugcaucaggauggcgguuuuagugaguauuugagcgugccgguggcgaacauuuugcccgcagacgguauugacccgc

SEQ ID NO: 4249827 - RNA, 70 nt, Shigella flexneri 2a str. 301; identical to SEQ ID NO: 4248852

SEQ ID NO: 4249828 - RNA, 73 nt, Shigella flexneri 2a str. 301
ggcuuuacgcugagggacuuucagcucaagaccuucggucagguucuuagcuaucaagucguugcguaccgcc

SEQ ID NO: 4249829 - RNA, 70 nt, Shigella flexneri 2a str. 301; identical to SEQ ID NO: 4227128

SEQ ID NO: 4249830 - RNA, 65 nt, Shigella flexneri 2a str. 301; identical to SEQ ID NO: 4249003

SEQ ID NO: 4249831 - RNA, 82 nt, Shigella flexneri 2a str. 301; identical to SEQ ID NO: 4249067

SEQ ID NO: 4249832 - RNA, 55 nt, Shigella flexneri 2a str. 301
uuggcgguauuggcguugguuuagccucaaugcuuucaccaauguauauugcgga

SEQ ID NO: 4249833 - RNA, 80 nt, Shigella flexneri 2a str. 301
cguugagaagauucgcguuauugcagaaagccaucccgucccuggcgaauaucacgcggugaccaguuaaacucucggcg

SEQ ID NO: 4249834 - RNA, 91 nt, Shigella flexneri 2a str. 301
gguuuucaccguuccgcgaccguggcagguugggcauucguuacacaguacgugcucaaugcuuucgcgggugcguuuacgcgucaucucc

SEQ ID NO: 4249835 - RNA, 77 nt, Shigella flexneri 2a str. 301; identical to SEQ ID NO: 4227869

SEQ ID NO: 4249836 - RNA, 56 nt, Shigella flexneri 2a str. 301; identical to SEQ ID NO: 4249328

SEQ ID NO: 4249837 - RNA, 63 nt, Shigella flexneri 2a str. 301; identical to SEQ ID NO: 4249089

SEQ ID NO: 4249838 - RNA, 78 nt, Shigella flexneri 2a str. 301; identical to SEQ ID NO: 4249579

SEQ ID NO: 4249839 - RNA, 76 nt, Shigella flexneri 2a str. 301; identical to SEQ ID NO: 4228271

SEQ ID NO: 4249840 - RNA, 80 nt, Shigella flexneri 2a str. 301; identical to SEQ ID NO: 4249678

SEQ ID NO: 4249841 - RNA, 58 nt, Shigella flexneri 2a str. 301; identical to SEQ ID NO: 4249467

SEQ ID NO: 4249842 - RNA, 74 nt, Shigella flexneri 2a str. 301
cgucacccaugucaccuuucaacacggcgauuuccagacagucgucgugguugaugugcacauguagcguggcg

SEQ ID NO: 4249843 - RNA, 63 nt, Shigella flexneri 2a str. 301; identical to SEQ ID NO: 4248754

SEQ ID NO: 4249844 - RNA, 71 nt, Shigella flexneri 2a str. 301
aggauugcauugcguaaacgcuuuuuauuuacaaaaaaauggggaaguguuacagcgauugcgaaaagccu

SEQ ID NO: 4249845 - RNA, 82 nt, Shigella flexneri 2a str. 301; identical to SEQ ID NO: 4249340

SEQ ID NO: 4249846 - RNA, 78 nt, Shigella flexneri 2a str. 301; identical to SEQ ID NO: 4228279

SEQ ID NO: 4249847 - RNA, 56 nt, Shigella flexneri 2a str. 301; identical to SEQ ID NO: 4227417

SEQ ID NO: 4249848 - RNA, 58 nt, Shigella flexneri 2a str. 301; identical to SEQ ID NO: 4249155

SEQ ID NO: 4249849 - RNA, 67 nt, Shigella flexneri 2a str. 301
guaacaguuucguuucaucaucuguugccauaccuaaaucaaccgcauccugaagcggagcuauuac

SEQ ID NO: 4249850 - RNA, 61 nt, Shigella flexneri 2a str. 301
agcacggcgcagcaggguguuacgaacaacacgcauguauacgccagcuucgcgaccugcu

SEQ ID NO: 4249851 - RNA, 62 nt, Shigella flexneri 2a str. 301; identical to SEQ ID NO: 4249587

SEQ ID NO: 4249852 - RNA, 62 nt, Shigella flexneri 2a str. 301; identical to SEQ ID NO: 4248785

SEQ ID NO: 4249853 - RNA, 77 nt, Shigella flexneri 2a str. 301; identical to SEQ ID NO: 4248850

SEQ ID NO: 4249854 - RNA, 71 nt, Shigella flexneri 2a str. 301
guguuauugaauguguuguuggauuuauggugcaaaaaaauuuugcauaaguucagcaacacaaagaacac

SEQ ID NO: 4249855 - RNA, 66 nt, Shigella flexneri 2a str. 301
uggcauguucugaggugucuuccugaagcgcguuuugcaacagggcaugaccaucagggcaggcua

SEQ ID NO: 4249856 - RNA, 83 nt, Shigella flexneri 2a str. 301
uauuucugcggggggcggugguucagugaugauuaaugguguugcgacauuauccagugcuucaucaucgacacgcgggagug

SEQ ID NO: 4249857 - RNA, 71 nt, Shigella flexneri 2a str. 301
gcuggcugucgacgcguauuuugccuucaccggaaggaguggugacggcguucuggacgcucuccgccagc

SEQ ID NO: 4249858 - RNA, 68 nt, Shigella flexneri 2a str. 301; identical to SEQ ID NO: 4228091

SEQ ID NO: 4249859 - RNA, 57 nt, Shigella flexneri 2a str. 301; identical to SEQ ID NO: 4248776

SEQ ID NO: 4249860 - RNA, 130 nt, Shigella flexneri 2a str. 301; identical to SEQ ID NO: 4248871

SEQ ID NO: 4249861 - RNA, 78 nt, Shigella flexneri 2a str. 301; identical to SEQ ID NO: 4249086

SEQ ID NO: 4249862 - RNA, 73 nt, Shigella flexneri 2a str. 301
guuagcgccguguuugguacggguaaacaccagcaccugcugccaguucccuuuaccaaucaugugcgacagc

SEQ ID NO: 4249863 - RNA, 79 nt, Shigella flexneri 2a str. 301; identical to SEQ ID NO: 4249646

SEQ ID NO: 4249864 - RNA, 63 nt, Shigella flexneri 2a str. 301; identical to SEQ ID NO: 4249645

SEQ ID NO: 4249865 - RNA, 69 nt, Shigella flexneri 2a str. 301
uaucacacacuguugugaaugaaagcauauugaaaaaauguuguuuugaaaacggcaguuuaggugaug

SEQ ID NO: 4249866 - RNA, 107 nt, Shigella flexneri 2a str. 301
gcaugcgccugcgccgaaaaauggucaggccguuggcaccaacaccauugguucuuccgaggccuguaugcucggcgggauggcgaugaaauggcguuggcgcaagc

SEQ ID NO: 4249867 - RNA, 63 nt, Shigella flexneri 2a str. 301
aaaacgaaugacugauugccgauaccugauuaaacgggucaucaaaaucaucauugcuguuuu

SEQ ID NO: 4249868 - RNA, 56 nt, Shigella flexneri 2a str. 301
cggguggaacugaggcaauucgucacguacugcaaccguugccgcuuuccagcccg

SEQ ID NO: 4249869 - RNA, 115 nt, Shigella flexneri 2a str. 301; identical to SEQ ID NO: 4249001

SEQ ID NO: 4249870 - RNA, 57 nt, Shigella flexneri 2a str. 301; identical to SEQ ID NO: 4227497

SEQ ID NO: 4249871 - RNA, 58 nt, Shigella flexneri 2a str. 301; identical to SEQ ID NO: 4228188

SEQ ID NO: 4249872 - RNA, 77 nt, Shigella flexneri 2a str. 301; identical to SEQ ID NO: 4249048

SEQ ID NO: 4249873 - RNA, 68 nt, Shigella flexneri 2a str. 301; identical to SEQ ID NO: 4249672

SEQ ID NO: 4249874 - RNA, 74 nt, Shigella flexneri 2a str. 301; identical to SEQ ID NO: 4249064

SEQ ID NO: 4249875 - RNA, 56 nt, Shigella flexneri 2a str. 301; identical to SEQ ID NO: 4249546

SEQ ID NO: 4249876 - RNA, 68 nt, Shigella flexneri 2a str. 301
uggcauaagagauaucuuuauuauuuagugcaucuagcucaacagauaaagaugucguuuuguugcua

SEQ ID NO: 4249877 - RNA, 60 nt, Shigella flexneri 2a str. 301
uugcgaauugccgaagugauuaaucuggugacagcgaaaaauauuacggcugauuugcaa

SEQ ID NO: 4249878 - RNA, 88 nt, Shigella flexneri 2a str. 301
gucagauuuugcaguugcaguccauuguuuugugaccagaagaccgcagaacacagaacaccgauacugucgcugcguuugcucuggc

SEQ ID NO: 4249879 - RNA, 93 nt, Shigella flexneri 2a str. 301; identical to SEQ ID NO: 4249580

SEQ ID NO: 4249880 - RNA, 60 nt, Shigella flexneri 2a str. 301
cguggaugauacuccagcugcacguugagaccggaaacuggguuguuguucucauccacg

SEQ ID NO: 4249881 - RNA, 58 nt, Shigella flexneri 2a str. 301
gcgucguauaaaaagaucggauggcgacgucguaucgccauccgauuugauauuacgc

SEQ ID NO: 4249882 - RNA, 58 nt, Shigella flexneri 2a str. 301; identical to SEQ ID NO: 4248904

SEQ ID NO: 4249883 - RNA, 89 nt, Shigella flexneri 2a str. 301
acugggaggccuauuuugccgagugcgaccgugacagcgucuacccggaacguuuugucaaagcacuggcggauauggguaucgacagu

SEQ ID NO: 4249884 - RNA, 72 nt, Shigella flexneri 2a str. 301; identical to SEQ ID NO: 4249399

SEQ ID NO: 4249885 - RNA, 82 nt, Shigella flexneri 2a str. 301
gucauaaaacgcuuuuucgaaaggcagaaaugcgagcaccagaucgguggcucugccuauuuugaaaacgcguuucugucgc

SEQ ID NO: 4249886 - RNA, 58 nt, Shigella flexneri 2a str. 301
uuccaugaagcaucgcgcaugggucgcgacuacgacaugacgcagaucuucacuggga

SEQ ID NO: 4249887 - RNA, 88 nt, Shigella flexneri 2a str. 301
gcuuuacgccugaugcgcugcgcuuaucaggccuacgagacguaucuacccguaggccggauaaggcguagacgcauccggcaaaagc

SEQ ID NO: 4249888 - RNA, 108 nt, Shigella flexneri 2a str. 301
ggcgaaacugaaagcgcgugguuacgaacaugcuggcgucuacaacccggaaggggucggugguacgcacguuauguacgugcugcaucacgccgaucagccggagcu

SEQ ID NO: 4249889 - RNA, 70 nt, Shigella flexneri 2a str. 301; identical to SEQ ID NO: 4227890

SEQ ID NO: 4249890 - RNA, 59 nt, Shigella flexneri 2a str. 301
gugcuggcaauauuccagucgaucgguauugcuaccggucugccgaauaugccugguau

SEQ ID NO: 4249891 - RNA, 63 nt, Shigella flexneri 2a str. 301; identical to SEQ ID NO: 4248998

SEQ ID NO: 4249892 - RNA, 61 nt, Shigella flexneri 2a str. 301; identical to SEQ ID NO: 4249193

SEQ ID NO: 4249893 - RNA, 88 nt, Shigella flexneri 2a str. 301
cuguuugcccaacguuugcagguagagcagauuauugccgucagcaaugaaacgcauauuuaccgcagccugcguuaucgcgauaaag

SEQ ID NO: 4249894 - RNA, 66 nt, Shigella flexneri 2a str. 301; identical to SEQ ID NO: 4249540

SEQ ID NO: 4249895 - RNA, 74 nt, Shigella flexneri 2a str. 301; identical to SEQ ID NO: 4249497

SEQ ID NO: 4249896 - RNA, 57 nt, Shigella flexneri 2a str. 301; identical to SEQ ID NO: 4249426

SEQ ID NO: 4249897 - RNA, 67 nt, Shigella flexneri 2a str. 301; identical to SEQ ID NO: 4249398

SEQ ID NO: 4249898 - RNA, 57 nt, Shigella flexneri 2a str. 301
gcagcgccagcugaaagguuuuaaaaaggaguuugccagccugucacugggcgcagc

SEQ ID NO: 4249899 - RNA, 87 nt, Shigella flexneri 2a str. 301; identical to SEQ ID NO: 4249070

SEQ ID NO: 4249900 - RNA, 65 nt, Shigella flexneri 2a str. 301; identical to SEQ ID NO: 4227652

SEQ ID NO: 4249901 - RNA, 72 nt, Shigella flexneri 2a str. 301; identical to SEQ ID NO: 4249616

SEQ ID NO: 4249902 - RNA, 77 nt, Shigella flexneri 2a str. 301
agcgcuaauuugcccuucaucgagugcgcggccggguaacagauuuaccgucaccgaugcagaaggggauuuuuguu

SEQ ID NO: 4249903 - RNA, 99 nt, Shigella flexneri 2a str. 301
ugucagauggccugauuuauaugggcaauaacggcgaagagcugaaagcguucaauguucgugacgguuauggcauucguugugcgcucaccucugaua

SEQ ID NO: 4249904 - RNA, 63 nt, Shigella flexneri 2a str. 301; identical to SEQ ID NO: 4249427

SEQ ID NO: 4249905 - RNA, 73 nt, Shigella flexneri 2a str. 301
gaccguaggguugccguugccgguuaucccgcuguuuguucaucaugaucugggcuauggcaauaccaugguc

SEQ ID NO: 4249906 - RNA, 127 nt, Shigella flexneri 2a str. 301
cguauugauauucguacaucgcagcugauuacaccgcuguuugaauauucaggugcuugccccgguuguggcgagacgccguauauuaaauugcugacucagcucuauggugaccggauguugaucg

SEQ ID NO: 4249907 - RNA, 90 nt, Shigella flexneri 2a str. 301; identical to SEQ ID NO: 4249659

SEQ ID NO: 4249908 - RNA, 56 nt, Shigella flexneri 2a str. 301; identical to SEQ ID NO: 4248868

SEQ ID NO: 4249909 - RNA, 108 nt, Shigella flexneri 2a str. 301
cauggaaugcuccucaauugauacuggcggcgauuauagccauauguuggcgcgguaucgacgaauuugcuauauuugcgccccugacaacaggagcgauucgcuaug

SEQ ID NO: 4249910 - RNA, 92 nt, Shigella flexneri 2a str. 301; identical to SEQ ID NO: 4248878

SEQ ID NO: 4249911 - RNA, 97 nt, Shigella flexneri 2a str. 301; identical to SEQ ID NO: 4249382

SEQ ID NO: 4249912 - RNA, 73 nt, Shigella flexneri 2a str. 301
ggcgacagugcgcagcggucaggccgaaacguuagccgaccaugaaggccgucaccugcugccaucuguuguu

SEQ ID NO: 4249913 - RNA, 72 nt, Shigella flexneri 2a str. 301
ggucugcccgaagaggugauuccugauuuggcggagcauuuacaggcgggaauugugguucugggcacgguc

SEQ ID NO: 4249914 - RNA, 55 nt, Shigella flexneri 2a str. 301; identical to SEQ ID NO: 4227827

SEQ ID NO: 4249915 - RNA, 80 nt, Shigella flexneri 2a str. 301; identical to SEQ ID NO: 4249584

SEQ ID NO: 4249916 - RNA, 97 nt, Shigella flexneri 2a str. 301
gcauacaaccgggcagugaugugauugucugcgcugaaauggacgaacauuggggcuacgucggugcuaaaucacgucagcgcuggcuguuuuacgc

SEQ ID NO: 4249917 - RNA, 64 nt, Shigella flexneri 2a str. 301
gaacgcaccauguugauguccagggcaagcaaaggugcuguugcccaucucaacguacugcguc

SEQ ID NO: 4249918 - RNA, 123 nt, Shigella flexneri 2a str. 301
guggaguuuaaugaugucgcuuacuggccgcagaucaaacaggugcuggaguggucgaaagaucacgucaccucgacgcuguuugucugcugggcgguacaggccgcgcucaauauccucuac

SEQ ID NO: 4249919 - RNA, 56 nt, Shigella flexneri 2a str. 301
gcccugauucugguaaccauaauuuuagugagguuuuuuuaccaugaaucagacgc

SEQ ID NO: 4249920 - RNA, 61 nt, Shigella flexneri 2a str. 301
ugucggugcgaguuugcuuaggaaugccguagaggauauugagcgcggccuguaccgccca

SEQ ID NO: 4249921 - RNA, 70 nt, Shigella flexneri 2a str. 301
cguccgguucuggaacgcgacgguauguugaugaugauugaugacaaccguaucgaccugcaaccgggcg

SEQ ID NO: 4249922 - RNA, 73 nt, Shigella flexneri 2a str. 301
guauuaaguugcaauugucuggucaauauuaacggugcguuuuugcugacuuuaaggcaguauguaacgaugc

SEQ ID NO: 4249923 - RNA, 71 nt, Shigella flexneri 2a str. 301
gcgucgagugcgugauuucgccgaagugaagcacgauggcaccaucucggcagauaucgcugcucaggcgc

SEQ ID NO: 4249924 - RNA, 96 nt, Shigella flexneri 2a str. 301
cuccggcuuccagguugagcauucccauaaacucagauccugcgugaagcagcaguaaaucugaguuuaugggaauaaauuaccugaaaaguagag

SEQ ID NO: 4249925 - RNA, 62 nt, Shigella flexneri 2a str. 301; identical to SEQ ID NO: 4248786

SEQ ID NO: 4249926 - RNA, 86 nt, Shigella flexneri 2a str. 301; identical to SEQ ID NO: 4248843

SEQ ID NO: 4249927 - RNA, 72 nt, Shigella flexneri 2a str. 301; identical to SEQ ID NO: 4249490

SEQ ID NO: 4249928 - RNA, 70 nt, Shigella flexneri 2a str. 301
gccauugugucucugucuccaauugcacaacgauuuccggcucugccuuuagggacaagagccacauggu

SEQ ID NO: 4249929 - RNA, 85 nt, Shigella flexneri 2a str. 301
gccagaagcugaacaauuauugcccguuuuacagcguuacggcuucgaaacgcucgaaaaacuggcaguuuuaggcugauuuggu

SEQ ID NO: 4249930 - RNA, 60 nt, Shigella flexneri 2a str. 301
ggcuuuccaguucaccagauugcccgacuuggcggugucgacgguggugacuggagaacc

SEQ ID NO: 4249931 - RNA, 64 nt, Shigella flexneri 2a str. 301; identical to SEQ ID NO: 4228045

SEQ ID NO: 4249932 - RNA, 70 nt, Shigella flexneri 2a str. 301; identical to SEQ ID NO: 4249259

SEQ ID NO: 4249933 - RNA, 58 nt, Shigella flexneri 2a str. 301
gcugauggccggucuugaugguaucaagaacaagauccauccgggcgaagccauggac

SEQ ID NO: 4249934 - RNA, 59 nt, Shigella flexneri 2a str. 301; identical to SEQ ID NO: 4227744

SEQ ID NO: 4249935 - RNA, 66 nt, Shigella flexneri 2a str. 301; identical to SEQ ID NO: 4249148

SEQ ID NO: 4249936 - RNA, 97 nt, Shigella flexneri 2a str. 301; identical to SEQ ID NO: 4248821

SEQ ID NO: 4249937 - RNA, 78 nt, Shigella flexneri 2a str. 301; identical to SEQ ID NO: 4249100

SEQ ID NO: 4249938 - RNA, 61 nt, Shigella flexneri 2a str. 301; identical to SEQ ID NO: 4227193

SEQ ID NO: 4249939 - RNA, 105 nt, Shigella flexneri 2a str. 301; identical to SEQ ID NO: 4249160

SEQ ID NO: 4249940 - RNA, 76 nt, Shigella flexneri 2a str. 301
gaugccgucuuuguagccaucauuuagcgcuugcugcuucugcugcaacugcugguuguuggcugcuaugcggcuc

SEQ ID NO: 4249941 - RNA, 56 nt, Shigella flexneri 2a str. 301
ucuccuucaacaaacagugcgccgggguaaucugucgucgccugaaguugaggagg

SEQ ID NO: 4249942 - RNA, 90 nt, Shigella flexneri 2a str. 301
cggcguauugagauuauggugcugaccaaaagugcguccgauacgcuguaucaauacuuuggucagcauggggauaaaguggugcagccg

SEQ ID NO: 4249943 - RNA, 81 nt, Shigella flexneri 2a str. 301; identical to SEQ ID NO: 4227615

SEQ ID NO: 4249944 - RNA, 56 nt, Shigella flexneri 2a str. 301
cggucugggugucgaugccuaugacagacaaaccuggggccgugcaccgcaggcug

SEQ ID NO: 4249945 - RNA, 59 nt, Shigella flexneri 2a str. 301; identical to SEQ ID NO: 4249486

SEQ ID NO: 4249946 - RNA, 81 nt, Shigella flexneri 2a str. 301
gugggacaaaguaauggaagguguuaaacuggaaaaccgcacucacgcgccaguugauuuugacaccgcuguugcuuccac

SEQ ID NO: 4249947 - RNA, 57 nt, Shigella flexneri 2a str. 301; identical to SEQ ID NO: 4249058

SEQ ID NO: 4249948 - RNA, 95 nt, Shigella flexneri 2a str. 301
gguucagguuauuaccggugaucaacauccacuuaucaucaacccacauuccuuucaggugauagguguugucgucaucuuuccauaaccgaacc

SEQ ID NO: 4249949 - RNA, 55 nt, Shigella flexneri 2a str. 301
uguugcuaagucuagggccgaucugauugcccgaacggaacugggaagagcaacg

SEQ ID NO: 4249950 - RNA, 114 nt, Shigella flexneri 2a str. 301; identical to SEQ ID NO: 4248765

SEQ ID NO: 4249951 - RNA, 73 nt, Shigella flexneri 2a str. 301
gcuuccuucuucagucagccgcaugagcagacgcaaaaagugcuugcugauauggcugcugcagagcaggagc

SEQ ID NO: 4249952 - RNA, 78 nt, Shigella flexneri 2a str. 301
guauauucugaauauuccgaauaguuacguaggguaaugacuccaacuuacugauaguguuuuauguucagauaaugc

SEQ ID NO: 4249953 - RNA, 63 nt, Shigella flexneri 2a str. 301
gcgugaugaagauugguaccgggcgucugcgugaccuuagcccgugcguaaucaucguugcgc

SEQ ID NO: 4249954 - RNA, 117 nt, Shigella flexneri 2a str. 301
cgccaggaccgaacaauauucucgcccuuagcucugcuacgucgcauggauuucgucaaaguacccgcgugcuggcagggaugagucugggauuuuugauugugauguuacugugug

SEQ ID NO: 4249955 - RNA, 75 nt, Shigella flexneri 2a str. 301
gggggcuggccuuuuuuccgguaugccgcucgauaaaaucgcagcgacgauggaaaaagggaugggaggcacccu

SEQ ID NO: 4249956 - RNA, 60 nt, Shigella flexneri 2a str. 301; identical to SEQ ID NO: 4228047

SEQ ID NO: 4249957 - RNA, 73 nt, Shigella flexneri 2a str. 301
ucaucaucgccucagaaaagaucgcuacgaguuucaagcagcucuucgacaucuuugucugccuugaugauga

SEQ ID NO: 4249958 - RNA, 92 nt, Shigella flexneri 2a str. 301
cgguaauggugcgauggugugggaucuggcuggcgucguugagcauugcgccaccuuccaugccaacgccuguuaaaucuggugcaaugccg

SEQ ID NO: 4249959 - RNA, 67 nt, Shigella flexneri 2a str. 301; identical to SEQ ID NO: 4249133

SEQ ID NO: 4249960 - RNA, 63 nt, Shigella flexneri 2a str. 301; identical to SEQ ID NO: 4248918

SEQ ID NO: 4249961 - RNA, 73 nt, Shigella flexneri 2a str. 301; identical to SEQ ID NO: 4248855

SEQ ID NO: 4249962 - RNA, 66 nt, Shigella flexneri 2a str. 301; identical to SEQ ID NO: 4249307

SEQ ID NO: 4249963 - RNA, 58 nt, Shigella flexneri 2a str. 301; identical to SEQ ID NO: 4248845

SEQ ID NO: 4249964 - RNA, 87 nt, Shigella flexneri 2a str. 301; identical to SEQ ID NO: 4248937

SEQ ID NO: 4249965 - RNA, 64 nt, Shigella flexneri 2a str. 301
gaugcggacaucaugcccgaggucgcgcagugugccauccgcgacuucggucagggugucguuc

SEQ ID NO: 4249966 - RNA, 57 nt, Shigella flexneri 2a str. 301; identical to SEQ ID NO: 4249269

SEQ ID NO: 4249967 - RNA, 117 nt, Shigella flexneri 2a str. 301; identical to SEQ ID NO: 4248863

SEQ ID NO: 4249968 - RNA, 100 nt, Shigella flexneri 2a str. 301; identical to SEQ ID NO: 4249657

SEQ ID NO: 4249969 - RNA, 72 nt, Shigella flexneri 2a str. 301
gguagugccguguggaauagcaauaccauugccgaggaacguugagguuugcuguucgcgcgccagcaugcc

SEQ ID NO: 4249970 - RNA, 58 nt, Shigella flexneri 2a str. 301
uuacuucuauugggcuuagcaucauucagguggguauugacugggccgcuggagguaa

SEQ ID NO: 4249971 - RNA, 64 nt, Shigella flexneri 2a str. 301; identical to SEQ ID NO: 4227844

SEQ ID NO: 4249972 - RNA, 93 nt, Shigella flexneri 2a str. 301
ggaucaguugaccgauccaguggcuguguaagaauccggaaacgcucacuuguuuccggauucuuuuaugcacauuggacaggcucuugaucu

SEQ ID NO: 4249973 - RNA, 98 nt, Shigella flexneri 2a str. 301
cgcuaaauugcagcuguggacgcgguuuaaccgacgcggagagauacguccguucuucgucagucaggacaaacugcgcccgguugcgauaccacgcg

SEQ ID NO: 4249974 - RNA, 129 nt, Shigella flexneri 2a str. 301; identical to SEQ ID NO: 4227515

SEQ ID NO: 4249975 - RNA, 78 nt, Shigella flexneri 2a str. 301; identical to SEQ ID NO: 4227789

SEQ ID NO: 4249976 - RNA, 78 nt, Shigella flexneri 2a str. 301
gcccagcuugccguagccgaccaccgcaaaaccgcgcccuucacguucguugaggugauuuggcuuaccguagcgggc

SEQ ID NO: 4249977 - RNA, 86 nt, Shigella flexneri 2a str. 301
acgccuguuaguugaaauuucgcauuuaauuucaugauuuuuaggagauuagucucaaaucagaauuuauuuuagcuaacaggugu

SEQ ID NO: 4249978 - RNA, 78 nt, Shigella flexneri 2a str. 301
cugauuuuaucgaccugauacggcgcaucgacaaaguaagccguuuuguugugcggcucuuucgggcugauauaccag

SEQ ID NO: 4249979 - RNA, 74 nt, Shigella flexneri 2a str. 301
agaaucccuggcgcaucugcaccugaccagaaccaugacaggucggacaggucugcggcuguguaccugguuuu

SEQ ID NO: 4249980 - RNA, 56 nt, Shigella flexneri 2a str. 301; identical to SEQ ID NO: 4248815

SEQ ID NO: 4249981 - RNA, 59 nt, Shigella flexneri 2a str. 301; identical to SEQ ID NO: 4248933

SEQ ID NO: 4249982 - RNA, 58 nt, Shigella flexneri 2a str. 301; identical to SEQ ID NO: 4248940

SEQ ID NO: 4249983 - RNA, 81 nt, Shigella flexneri 2a str. 301; identical to SEQ ID NO: 4249300

SEQ ID NO: 4249984 - RNA, 56 nt, Shigella flexneri 2a str. 301
accuggguuggugguuacccgaaacucaauacgaucggcaccgucagcgcccaggu

SEQ ID NO: 4249985 - RNA, 83 nt, Shigella flexneri 2a str. 301
cgcuguacauuacguucauuaccggcgcauacaccacaccuaaaaucgguuugccauggucaaugagcgcaauguuaacggug

SEQ ID NO: 4249986 - RNA, 55 nt, Shigella flexneri 2a str. 301; identical to SEQ ID NO: 4248866

SEQ ID NO: 4249987 - RNA, 76 nt, Shigella flexneri 2a str. 301
ucaggguuaguaugcacugucagauccggcguggacacuugauccgacguacggccagugcguuuuguaggccuga

SEQ ID NO: 4249988 - RNA, 81 nt, Shigella flexneri 2a str. 301
cugaucgucaauaaagcggugcgauaacgaaccgcuggcaaggaccgccacggugccgucguacuguucgaucgcuuucag

SEQ ID NO: 4249989 - RNA, 61 nt, Shigella flexneri 2a str. 301
acguuaccggucagaaucgccagcaucgagauagcacggguugcgauuucaccguuagcgu

SEQ ID NO: 4249990 - RNA, 73 nt, Shigella flexneri 2a str. 301; identical to SEQ ID NO: 4248820

SEQ ID NO: 4249991 - RNA, 75 nt, Shigella flexneri 2a str. 301; identical to SEQ ID NO: 4248955

SEQ ID NO: 4249992 - RNA, 83 nt, Shigella flexneri 2a str. 301
ccggaaauugucgauuuuuaccugccgccggaaggcuguucuuaucgucuggcgguagugacgaucaaaaaacaguacgccgg

SEQ ID NO: 4249993 - RNA, 78 nt, Shigella flexneri 2a str. 301
gcgcagucggaugcugaccaugggcgauucgguggugaaaauuucccucgccucgcuggucgguuugcugaccauagc

SEQ ID NO: 4249994 - RNA, 58 nt, Shigella flexneri 2a str. 301
gcccgagcuaaccuguuaaaggugcaaaagauugcaccuuuuucagauuaccucgggc

SEQ ID NO: 4249995 - RNA, 75 nt, Shigella flexneri 2a str. 301; identical to SEQ ID NO: 4249071

SEQ ID NO: 4249996 - RNA, 68 nt, Shigella flexneri 2a str. 301
auaauucagggucuggauugccugcaauacgcggucacgcguugcaggacgcacagauucugcauuau

SEQ ID NO: 4249997 - RNA, 88 nt, Shigella flexneri 2a str. 301
uuccguuuugccuguguguugaauaauuccacugcaguuauauaaaaucgguaacggcuggaaaucauucaauacucgcacuaucgaa

SEQ ID NO: 4249998 - RNA, 56 nt, Shigella flexneri 2a str. 301; identical to SEQ ID NO: 4249327

SEQ ID NO: 4249999 - RNA, 89 nt, Shigella flexneri 2a str. 301; identical to SEQ ID NO: 4249309

SEQ ID NO: 4250000 - RNA, 69 nt, Shigella flexneri 2a str. 301; identical to SEQ ID NO: 4227373

SEQ ID NO: 4250001 - RNA, 79 nt, Shigella flexneri 2a str. 301
ggggcauuggccugaauaucuccacuggcgguaagcugaauauugccgucgccagucaacgguaauucaggccaucccc

SEQ ID NO: 4250002 - RNA, 66 nt, Shigella flexneri 2a str. 301
gcuaccaccuuucgccaagaucaggccgccgcgcggacccgccaggguuuugugaguggugguagu

SEQ ID NO: 4250003 - RNA, 88 nt, Shigella flexneri 2a str. 301
ggcgcgauuuauggcgugcgcuuauuacagguucugcgcgaugucacagauaucgaaacgcaucuggugaugagccaggcggcgcgcc

SEQ ID NO: 4250004 - RNA, 62 nt, Shigella flexneri 2a str. 301; identical to SEQ ID NO: 4249293

SEQ ID NO: 4250005 - RNA, 69 nt, Shigella flexneri 2a str. 301; identical to SEQ ID NO: 4248809

SEQ ID NO: 4250006 - RNA, 56 nt, Shigella flexneri 2a str. 301; identical to SEQ ID NO: 4249136

SEQ ID NO: 4250007 - RNA, 66 nt, Shigella flexneri 2a str. 301
ucugccgcguccaaauguugaucgcgaugcgccggauauccgcguuaacgucuggcugcauaaaga

SEQ ID NO: 4250008 - RNA, 61 nt, Shigella flexneri 2a str. 301; identical to SEQ ID NO: 4228196

SEQ ID NO: 4250009 - RNA, 74 nt, Shigella flexneri 2a str. 301; identical to SEQ ID NO: 4227792

SEQ ID NO: 4250010 - RNA, 68 nt, Shigella flexneri 2a str. 301; identical to SEQ ID NO: 4249521

SEQ ID NO: 4250011 - RNA, 63 nt, Shigella flexneri 2a str. 301; identical to SEQ ID NO: 4228035

SEQ ID NO: 4250012 - RNA, 60 nt, Shigella flexneri 2a str. 301
gcgccaggucauucaugcggguuuucuccccgagaaugcuaccgccagugaccgggcugc

SEQ ID NO: 4250013 - RNA, 75 nt, Shigella flexneri 2a str. 301; identical to SEQ ID NO: 4227530

SEQ ID NO: 4250014 - RNA, 68 nt, Shigella flexneri 2a str. 301; identical to SEQ ID NO: 4249648

SEQ ID NO: 4250015 - RNA, 83 nt, Shigella flexneri 2a str. 301; identical to SEQ ID NO: 4249200

SEQ ID NO: 4250016 - RNA, 83 nt, Shigella flexneri 2a str. 301
accaaaguuggcgacugucuggagauggcaaaaucgcucgccggaaguggcaagcagauugugcucuccacgcuggcgcuggu

SEQ ID NO: 4250017 - RNA, 55 nt, Shigella flexneri 2a str. 301
agcgucccguuucgaucuuaguggucaucuaugcacaagauacgaaacgggugcu

SEQ ID NO: 4250018 - RNA, 68 nt, Shigella flexneri 2a str. 301
ccagacuaucaauauuuugcguauucagcgguuuaccgcuauagcaaccgaccauauugguggccugg

SEQ ID NO: 4250019 - RNA, 70 nt, Shigella flexneri 2a str. 301; identical to SEQ ID NO: 4249509

SEQ ID NO: 4250020 - RNA, 59 nt, Shigella flexneri 2a str. 301
ucagugccaguucguuuaucggcgggccaggagcugcuuauaaauacgggcugggcugg

SEQ ID NO: 4250021 - RNA, 68 nt, Shigella flexneri 2a str. 301; identical to SEQ ID NO: 4249512

SEQ ID NO: 4250022 - RNA, 65 nt, Shigella flexneri 2a str. 301; identical to SEQ ID NO: 4249629

SEQ ID NO: 4250023 - RNA, 88 nt, Shigella flexneri 2a str. 301; identical to SEQ ID NO: 4249206

SEQ ID NO: 4250024 - RNA, 55 nt, Shigella flexneri 2a str. 301; identical to SEQ ID NO: 4228008

SEQ ID NO: 4250025 - RNA, 98 nt, Shigella flexneri 2a str. 301
uuguuggggauugcacuggugauuggcgcaggcaugguuugguggaucaaccgcuccauugcccggcucacucgcuaugcugauuccgucacugacaa

SEQ ID NO: 4250026 - RNA, 62 nt, Shigella flexneri 2a str. 301
caaggugucgaugcguugcucuugcagguauuuacuugcgccaagagccagcgugucgguug

SEQ ID NO: 4250027 - RNA, 107 nt, Shigella flexneri 2a str. 301
cuggcgagcauguugagaaguagugacgugauaaucgcuggaaucuucagucgguuccgcguuaucaguccauuuguuuucuuccgccauacgacgugcuucuucag

SEQ ID NO: 4250028 - RNA, 68 nt, Shigella flexneri 2a str. 301
ccaggcccguaauaucacccgguucgggaccaucgaaucggucacuuaugauauugccgaggggucgg

SEQ ID NO: 4250029 - RNA, 62 nt, Shigella flexneri 2a str. 301; identical to SEQ ID NO: 4249527

SEQ ID NO: 4250030 - RNA, 91 nt, Shigella flexneri 2a str. 301
gacccgcagcaaacaacacaaauuauuacagacugcccgcuuguggcucgcgcgucauaaugggaguuuugauacuguggauugccgguuc

SEQ ID NO: 4250031 - RNA, 58 nt, Shigella flexneri 2a str. 301; identical to SEQ ID NO: 4248909

SEQ ID NO: 4250032 - RNA, 73 nt, Shigella flexneri 2a str. 301; identical to SEQ ID NO: 4248984

SEQ ID NO: 4250033 - RNA, 66 nt, Shigella flexneri 2a str. 301
ugcuugcucugguuguaugcguagucuggcaaguauuuagccgcuacguacuuaaccagccaagua

SEQ ID NO: 4250034 - RNA, 57 nt, Shigella flexneri 2a str. 301
cgaugaucaugaugucggcaucuuugcccugaauggugcugccaucaucggucaccg

SEQ ID NO: 4250035 - RNA, 71 nt, Shigella flexneri 2a str. 301; identical to SEQ ID NO: 4227486

SEQ ID NO: 4250036 - RNA, 57 nt, Shigella flexneri 2a str. 301; identical to SEQ ID NO: 4249514

SEQ ID NO: 4250037 - RNA, 62 nt, Shigella flexneri 2a str. 301; identical to SEQ ID NO: 4249213

SEQ ID NO: 4250038 - RNA, 124 nt, Shigella flexneri 2a str. 301
ggugcucaaugccugaugcgacgcuuaccgcgucuuaucaggccuacaguuuuacaacguauugaaauugcugguuuuguaggccggauaaggcguucgcgccgcauccggcauuuuacgcauu

SEQ ID NO: 4250039 - RNA, 68 nt, Shigella flexneri 2a str. 301; identical to SEQ ID NO: 4249695

SEQ ID NO: 4250040 - RNA, 56 nt, Shigella flexneri 2a str. 301
acagucucaaccagauaguaacauuaauauucauguugucuaugguucagagcugu

SEQ ID NO: 4250041 - RNA, 66 nt, Shigella flexneri 2a str. 301
aauccagcgcaggcuacgguggagaauuuucgccaccccuuuuucguagcguucggcguugcgguu

SEQ ID NO: 4250042 - RNA, 64 nt, Shigella flexneri 2a str. 301
uaucacgcacagauuuggcaucggccgggaaaucuaccgguggauucaagucggugcgacgaua

SEQ ID NO: 4250043 - RNA, 104 nt, Shigella flexneri 2a str. 301
guucugccagcuggcguuugagacgugcaaucucgguagacaucuccaguucacguucagaagacgucugcugauuuuguuguuuacugcgccaguuguagagc

SEQ ID NO: 4250044 - RNA, 71 nt, Shigella flexneri 2a str. 301; identical to SEQ ID NO: 4249120

SEQ ID NO: 4250045 - RNA, 72 nt, Shigella flexneri 2a str. 301; identical to SEQ ID NO: 4249524

SEQ ID NO: 4250046 - RNA, 66 nt, Shigella flexneri 2a str. 301; identical to SEQ ID NO: 4249415

SEQ ID NO: 4250047 - RNA, 68 nt, Shigella flexneri 2a str. 301; identical to SEQ ID NO: 4249047

SEQ ID NO: 4250048 - RNA, 80 nt, Shigella flexneri 2a str. 301
gugguugagcguguugaaugccggaaucaggggcuggagaaauccaggacguugaugaccgguauugaugaacuggacgc

SEQ ID NO: 4250049 - RNA, 97 nt, Shigella flexneri 2a str. 301; identical to SEQ ID NO: 4249198

SEQ ID NO: 4250050 - RNA, 65 nt, Shigella flexneri 2a str. 301; identical to SEQ ID NO: 4249696

SEQ ID NO: 4250051 - RNA, 79 nt, Shigella flexneri 2a str. 301
uccucuucuccuuucgagagucagugguacgucugaaaucggucagacgcgaugcauugcucugaaagcauagacggga

SEQ ID NO: 4250052 - RNA, 58 nt, Shigella flexneri 2a str. 301; identical to SEQ ID NO: 4248981

SEQ ID NO: 4250053 - RNA, 85 nt, Shigella flexneri 2a str. 301; identical to SEQ ID NO: 4248805

SEQ ID NO: 4250054 - RNA, 85 nt, Shigella flexneri 2a str. 301; identical to SEQ ID NO: 4249717

SEQ ID NO: 4250055 - RNA, 75 nt, Shigella flexneri 2a str. 301
ugccguuaguggacgcugauguacaggagcaguuguuaugaucuucucugacuggccguggcgucacuggcggca

SEQ ID NO: 4250056 - RNA, 68 nt, Shigella flexneri 2a str. 301; identical to SEQ ID NO: 4248925

SEQ ID NO: 4250057 - RNA, 91 nt, Shigella flexneri 2a str. 301
gcuaugugaagugacggugaagucguagcgaggccagcacgccaccuuccugcacguugcgcagcgugacuucgccguuaaacaaacgggc

SEQ ID NO: 4250058 - RNA, 92 nt, Shigella flexneri 2a str. 301; identical to SEQ ID NO: 4228350

SEQ ID NO: 4250059 - RNA, 59 nt, Shigella flexneri 2a str. 301; identical to SEQ ID NO: 4249117

SEQ ID NO: 4250060 - RNA, 81 nt, Shigella flexneri 2a str. 301; identical to SEQ ID NO: 4249116

SEQ ID NO: 4250061 - RNA, 89 nt, Shigella flexneri 2a str. 301
cgcccgccauguuugguguacuggugauugugcaaucguacgccaagucgaucagcgauuuuauuaaguuucagacauggcagcuggug

SEQ ID NO: 4250062 - RNA, 63 nt, Shigella flexneri 2a str. 301
cagaggcuguaauggucguuauucaucacccaucgcuuuugugauggcgaccauugacuucug

SEQ ID NO: 4250063 - RNA, 55 nt, Shigella flexneri 2a str. 301
cgcucauuuuuguucgguguggcgcaaaaagaacguccucaacaaucugugggcg

SEQ ID NO: 4250064 - RNA, 124 nt, Shigella flexneri 2a str. 301; identical to SEQ ID NO: 4249494

SEQ ID NO: 4250065 - RNA, 72 nt, Shigella flexneri 2a str. 301; identical to SEQ ID NO: 4248992

SEQ ID NO: 4250066 - RNA, 68 nt, Shigella flexneri 2a str. 301; identical to SEQ ID NO: 4248985

SEQ ID NO: 4250067 - RNA, 76 nt, Shigella flexneri 2a str. 301
caguuuauucaccgucaggguacggaauguacggucuccuucagaacuaauacggcuguuucugacgguaagacug

SEQ ID NO: 4250068 - RNA, 65 nt, Shigella flexneri 2a str. 301; identical to SEQ ID NO: 4249247

SEQ ID NO: 4250069 - RNA, 71 nt, Shigella flexneri 2a str. 301; identical to SEQ ID NO: 4227345

SEQ ID NO: 4250070 - RNA, 57 nt, Shigella flexneri 2a str. 301; identical to SEQ ID NO: 4249208

SEQ ID NO: 4250071 - RNA, 100 nt, Shigella flexneri 2a str. 301
ugggcgaguguaagguuuacagcgauuuagaccucuaucucgguguucaggcgaucaacuggacagagauguuuaauccuggcgcgaccuucgcugucca

SEQ ID NO: 4250072 - RNA, 76 nt, Shigella flexneri 2a str. 301; identical to SEQ ID NO: 4249711

SEQ ID NO: 4250073 - RNA, 63 nt, Shigella flexneri 2a str. 301; identical to SEQ ID NO: 4248999

SEQ ID NO: 4250074 - RNA, 123 nt, Shigella flexneri 2a str. 301
cucugcaaucagcgguaagccuuguagccccaacauuuuuugcaaguacagcauuuccgcuaaaguuuuacugcuacagagaaugacgggaauauuggcuucguguaaacggcugagccaggg

SEQ ID NO: 4250075 - RNA, 107 nt, Shigella flexneri 2a str. 301
cgucaggcaaguaaguuacgcguuguuuuugcgacagaugaagagcuggcagcacaugaagcccgucucgaucuggugcagaaaaaaggcggaagcugccucuggcg

SEQ ID NO: 4250076 - RNA, 57 nt, Shigella flexneri 2a str. 301; identical to SEQ ID NO: 4248926

SEQ ID NO: 4250077 - RNA, 63 nt, Shigella flexneri 2a str. 301; identical to SEQ ID NO: 4249560

SEQ ID NO: 4250078 - RNA, 58 nt, Shigella flexneri 2a str. 301; identical to SEQ ID NO: 4249034

SEQ ID NO: 4250079 - RNA, 68 nt, Shigella flexneri 2a str. 301
gccugagcggcacgcugaugcgaacggugcgcuaaugcaucuugcuguucucgggugaugccguaggu

SEQ ID NO: 4250080 - RNA, 107 nt, Shigella flexneri 2a str. 301; identical to SEQ ID NO: 4249595

SEQ ID NO: 4250081 - RNA, 70 nt, Shigella flexneri 2a str. 301
ggugaaacuuggcgaucauccgcaaaauccaucguggucgcugggugugcuggggaugccaggcuuuacc

SEQ ID NO: 4250082 - RNA, 70 nt, Shigella flexneri 2a str. 301; identical to SEQ ID NO: 4228052

SEQ ID NO: 4250083 - RNA, 93 nt, Shigella flexneri 2a str. 301
gcagagcacgcuuaauuugcccuuuauguccgguaguagugggauuguaagaacgcauacugaccgacucagggcagacauaggguaauuugu

SEQ ID NO: 4250084 - RNA, 124 nt, Shigella flexneri 2a str. 301; identical to SEQ ID NO: 4249170

SEQ ID NO: 4250085 - RNA, 66 nt, Shigella flexneri 2a str. 301
ugcgguggugguuauucuucagguggcaaaacgucuugccccacagcugaugaacuguccaccgca

SEQ ID NO: 4250086 - RNA, 61 nt, Shigella flexneri 2a str. 301
uggccguuggggaagugacuccuaacccaaacaugcguccgguugcuucacucaggggcca

SEQ ID NO: 4250087 - RNA, 71 nt, Shigella flexneri 2a str. 301; identical to SEQ ID NO: 4248922

SEQ ID NO: 4250088 - RNA, 68 nt, Shigella flexneri 2a str. 301
gcuuuacgcgcgaccaacggguaguauugcgaauggugguguuaucguugaugucgugcucaaaacgc

SEQ ID NO: 4250089 - RNA, 72 nt, Shigella flexneri 2a str. 301; identical to SEQ ID NO: 4249258

SEQ ID NO: 4250090 - RNA, 61 nt, Shigella flexneri 2a str. 301; identical to SEQ ID NO: 4249074

SEQ ID NO: 4250091 - RNA, 67 nt, Shigella flexneri 2a str. 301; identical to SEQ ID NO: 4228150

SEQ ID NO: 4250092 - RNA, 80 nt, Shigella flexneri 2a str. 301
aggguucaagaaggcgaugaaugaugacgaugcugcggcgaaaaaaggcgcagacguugaucuucaggcugaaaagcucu

SEQ ID NO: 4250093 - RNA, 58 nt, Shigella flexneri 2a str. 301
ccgcguuuccagguguucggcgcugacgcaaugcgcggcccgcgcggccugaaagcgg

SEQ ID NO: 4250094 - RNA, 84 nt, Shigella flexneri 2a str. 301
gauggcaaaggcguuacgcucuugauccuguuccggccaggcaaccacauggaacggugcaggagcagguuccguuugccacuc

SEQ ID NO: 4250095 - RNA, 87 nt, Shigella flexneri 2a str. 301; identical to SEQ ID NO: 4249283

SEQ ID NO: 4250096 - RNA, 77 nt, Shigella flexneri 2a str. 301
cgcgaauacaucauucugcuugagaucgcacugucagcauuaucgcugcugcuuugcggccuucaggcagaaccgcg

SEQ ID NO: 4250097 - RNA, 130 nt, Shigella flexneri 2a str. 301; identical to SEQ ID NO: 4249132

SEQ ID NO: 4250098 - RNA, 96 nt, Shigella flexneri 2a str. 301
ggggcagagcgguaccaccguggccuuuuccgguauagcggcagcagaaccguugcgauuuaucugggaagugccaggcggugggugaaccgcccc

SEQ ID NO: 4250099 - RNA, 90 nt, Shigella flexneri 2a str. 301
gcgacgaccagcaguucgcgaauacgcugcucacggguuucaccuuuauggccuuccggcagcgcguuggugaagugcggguugauuugc

SEQ ID NO: 4250100 - RNA, 61 nt, Shigella flexneri 2a str. 301; identical to SEQ ID NO: 4249518

SEQ ID NO: 4250101 - RNA, 76 nt, Shigella flexneri 2a str. 301
gcaguuccggcaguuauuguggcgauaccagaucagacagaguaugagccggcgcggaaacugcugggauaacagc

SEQ ID NO: 4250102 - RNA, 60 nt, Shigella flexneri 2a str. 301; identical to SEQ ID NO: 4248752

SEQ ID NO: 4250103 - RNA, 61 nt, Shigella flexneri 2a str. 301
uugaggaugugcgcacgguccgcgaauuagguuuuccuggacuggugacgggcguucucga

SEQ ID NO: 4250104 - RNA, 73 nt, Shigella flexneri 2a str. 301; identical to SEQ ID NO: 4248851

SEQ ID NO: 4250105 - RNA, 65 nt, Shigella flexneri 2a str. 301; identical to SEQ ID NO: 4249233

SEQ ID NO: 4250106 - RNA, 88 nt, Shigella flexneri 2a str. 301
cgcgacgccagacucggcuccguggaugaucucguuggcgauuuuuauugcuaaagauuugauuaccguggugccguugcuggccgcg

SEQ ID NO: 4250107 - RNA, 75 nt, Shigella flexneri 2a str. 301; identical to SEQ ID NO: 4249121

SEQ ID NO: 4250108 - RNA, 116 nt, Shigella flexneri 2a str. 301
auccaccaccagcacgcguuugucgccaucuuuaauggcuggcagguaauuuugcgccaugcaguagcaagugccaugcucagucaggguuucggcaaucacgccgagguuuggau

SEQ ID NO: 4250109 - RNA, 76 nt, Shigella flexneri 2a str. 301
cagccugcagugcaauauaaugagccgcugcaacaaccaguacagccgcagcagccguauuaugcaccugcagcug

SEQ ID NO: 4250110 - RNA, 59 nt, Shigella flexneri 2a str. 301; identical to SEQ ID NO: 4249515

SEQ ID NO: 4250111 - RNA, 61 nt, Shigella flexneri 2a str. 301; identical to SEQ ID NO: 4249068

SEQ ID NO: 4250112 - RNA, 71 nt, Shigella flexneri 2a str. 301; identical to SEQ ID NO: 4249102

SEQ ID NO: 4250113 - RNA, 80 nt, Shigella flexneri 2a str. 301
ccauaucgacgccguugagagcaaauuguuuggcauuggcgcagagagcuacacgguuggcuccaaugaguuuuacaugg

SEQ ID NO: 4250114 - RNA, 66 nt, Shigella flexneri 2a str. 301
gccgacuggccgacaacgcuugcuggucgcauuuauuccuacguaagcauuaucggccauuucagc

SEQ ID NO: 4250115 - RNA, 61 nt, Shigella flexneri 2a str. 301
cacgaguuuaucaccgguggcgaauaucgucguaucugcacgcugggugagaaacugcgug

SEQ ID NO: 4250116 - RNA, 74 nt, Shigella flexneri 2a str. 301; identical to SEQ ID NO: 4249278

SEQ ID NO: 4250117 - RNA, 104 nt, Shigella flexneri 2a str. 301; identical to SEQ ID NO: 4249002

SEQ ID NO: 4250118 - RNA, 95 nt, Shigella flexneri 2a str. 301; identical to SEQ ID NO: 4227665

SEQ ID NO: 4250119 - RNA, 79 nt, Shigella flexneri 2a str. 301; identical to SEQ ID NO: 4249236

SEQ ID NO: 4250120 - RNA, 129 nt, Shigella flexneri 2a str. 301; identical to SEQ ID NO: 4249235

SEQ ID NO: 4250121 - RNA, 86 nt, Shigella flexneri 2a str. 301; identical to SEQ ID NO: 4249581

SEQ ID NO: 4250122 - RNA, 57 nt, Shigella flexneri 2a str. 301; identical to SEQ ID NO: 4249363

SEQ ID NO: 4250123 - RNA, 56 nt, Shigella flexneri 2a str. 301; identical to SEQ ID NO: 4248996

SEQ ID NO: 4250124 - RNA, 62 nt, Shigella flexneri 2a str. 301; identical to SEQ ID NO: 4249408

SEQ ID NO: 4250125 - RNA, 61 nt, Shigella flexneri 2a str. 301
guucauugcuauucuaccuaucgccaugaacuaucguggcgauggaggauggauaaugaau

SEQ ID NO: 4250126 - RNA, 76 nt, Shigella flexneri 2a str. 301; identical to SEQ ID NO: 4228014

SEQ ID NO: 4250127 - RNA, 61 nt, Shigella flexneri 2a str. 301; identical to SEQ ID NO: 4249397

SEQ ID NO: 4250128 - RNA, 65 nt, Shigella flexneri 2a str. 301; identical to SEQ ID NO: 4249422

SEQ ID NO: 4250129 - RNA, 63 nt, Shigella flexneri 2a str. 301; identical to SEQ ID NO: 4248889

SEQ ID NO: 4250130 - RNA, 55 nt, Shigella flexneri 2a str. 301; identical to SEQ ID NO: 4227409

SEQ ID NO: 4250131 - RNA, 58 nt, Shigella flexneri 2a str. 301; identical to SEQ ID NO: 4249251

SEQ ID NO: 4250132 - RNA, 70 nt, Shigella flexneri 2a str. 301; identical to SEQ ID NO: 4249022

SEQ ID NO: 4250133 - RNA, 93 nt, Shigella flexneri 2a str. 301; identical to SEQ ID NO: 4248881

SEQ ID NO: 4250134 - RNA, 75 nt, Shigella flexneri 2a str. 301; identical to SEQ ID NO: 4228219

SEQ ID NO: 4250135 - RNA, 64 nt, Shigella flexneri 2a str. 301
gguuugggugaguuauggcguggcgcaaaagguuuuauugcgucggcuggccucaccgcagauc

SEQ ID NO: 4250136 - RNA, 64 nt, Shigella flexneri 2a str. 301; identical to SEQ ID NO: 4249624

SEQ ID NO: 4250137 - RNA, 100 nt, Shigella flexneri 2a str. 301; identical to SEQ ID NO: 4228020

SEQ ID NO: 4250138 - RNA, 57 nt, Shigella flexneri 2a str. 301
gcgguuuauguuucgccugugcggggucuucacuccacgcgagaucgacaaaaucgc

SEQ ID NO: 4250139 - RNA, 57 nt, Shigella flexneri 2a str. 301
gacagcaaacugggcgucuuuauugucuucgaaggugaagccauccaguucguuuuc

SEQ ID NO: 4250140 - RNA, 56 nt, Shigella flexneri 2a str. 301
cucaggcaagagugguuauacauaugcauaaugcauuugaaccaaaauugcuugag

SEQ ID NO: 4250141 - RNA, 72 nt, Shigella flexneri 2a str. 301
gccaaugaaauccggguugcuguaaacgcggaaacuuuugccgcagugcagcagcugcuggagaucaucggc

SEQ ID NO: 4250142 - RNA, 117 nt, Shigella flexneri 2a str. 301
ucaguaugggaugcauccucgucggcguauuacuggugccaguaacuguaaaauguuuugguaaaaaacagguuuauuuagcuggcauggugcuaugggcggugggugauauacuga

SEQ ID NO: 4250143 - RNA, 113 nt, Shigella flexneri 2a str. 301
ccucgcgcauacaaccgggcagugaugugauugucugcgcugaaauggacgaacauugggguuacgucggugcuaaaucacgucagcgcuggcuguuuuacgcguaugacagg

SEQ ID NO: 4250144 - RNA, 76 nt, Shigella flexneri 2a str. 301
ccgggcaaguuucauggugaauuuacggaaauucuacucgaugauauucagguuuuucgugaauacaccggucugg

SEQ ID NO: 4250145 - RNA, 99 nt, Shigella flexneri 2a str. 301; identical to SEQ ID NO: 4248839

SEQ ID NO: 4250146 - RNA, 55 nt, Shigella flexneri 2a str. 301; identical to SEQ ID NO: 4248803

SEQ ID NO: 4250147 - RNA, 76 nt, Shigella flexneri 2a str. 301
gagcacgaagugaaguuuguugauuugcgcuucaccgauaccaaagguaaagaacaacacgucacuaucccugcuc

SEQ ID NO: 4250148 - RNA, 81 nt, Shigella flexneri 2a str. 301; identical to SEQ ID NO: 4248756

SEQ ID NO: 4250149 - RNA, 67 nt, Shigella flexneri 2a str. 301; identical to SEQ ID NO: 4249292

SEQ ID NO: 4250150 - RNA, 61 nt, Shigella flexneri 2a str. 301; identical to SEQ ID NO: 4249161

SEQ ID NO: 4250151 - RNA, 86 nt, Shigella flexneri 2a str. 301; identical to SEQ ID NO: 4249264

SEQ ID NO: 4250152 - RNA, 91 nt, Shigella flexneri 2a str. 301
gccuuuguccucuuuucuaccgcuucuucacaacguuuauuccagggcgaccagauggcgccguugcugaugaagcugguggauaaauggc

SEQ ID NO: 4250153 - RNA, 58 nt, Shigella flexneri 2a str. 301; identical to SEQ ID NO: 4245823

SEQ ID NO: 4250154 - RNA, 70 nt, Shigella flexneri 2a str. 301
acgggaugcuggagcuuggcaccagcgagcggggcgggcuuuccauucgcgccuggcugccagugccggu

SEQ ID NO: 4250155 - RNA, 87 nt, Shigella flexneri 2a str. 301; identical to SEQ ID NO: 4248842

SEQ ID NO: 4250156 - RNA, 56 nt, Shigella flexneri 2a str. 301
acgguggaaggcgcggagcugggaucgcagcgucuggucuuccggccuggcaccgu

SEQ ID NO: 4250157 - RNA, 62 nt, Shigella flexneri 2a str. 301
ccgcuguaugccaucugcgcauccaacgacguggcggugucgaugauggacggcaacagcgg

SEQ ID NO: 4250158 - RNA, 61 nt, Shigella flexneri 2a str. 301; identical to SEQ ID NO: 4248837

SEQ ID NO: 4250159 - RNA, 73 nt, Shigella flexneri 2a str. 301; identical to SEQ ID NO: 4249662

SEQ ID NO: 4250160 - RNA, 64 nt, Shigella flexneri 2a str. 301
ggccgccacgccugcgaauaaugggauuaccagcuucaccagguucguaccgguguggcgcgcc

SEQ ID NO: 4250161 - RNA, 108 nt, Shigella flexneri 2a str. 301
gccugaucccggaguucaugcgugaugcaaugaaaguaccguucuacuucggugggaccucacugcuuaucguuguugucgugauuauggacuuuauggcucaagugc

SEQ ID NO: 4250162 - RNA, 127 nt, Shigella flexneri 2a str. 301
ucgguaaccucgcgcauacaaccgggcagugaugugauugucugcgcugaaauggacgaacauuggggcuacgucggugcuaaaucacgucagcgcuggcuguuuuacgcguaugacaggauacgga

SEQ ID NO: 4250163 - RNA, 100 nt, Shigella flexneri 2a str. 301; identical to SEQ ID NO: 4249318

SEQ ID NO: 4250164 - RNA, 63 nt, Shigella flexneri 2a str. 301; identical to SEQ ID NO: 4249224

SEQ ID NO: 4250165 - RNA, 82 nt, Shigella flexneri 2a str. 301
ggggagcugccgacaggguggcugugcgaugcgcuggaucagauauuuaucgccgcaccacaacugucagcaguggcucucc

SEQ ID NO: 4250166 - RNA, 102 nt, Shigella flexneri 2a str. 301
ugcccgaacgguuguggucgcgcgaugcuggcggaagugggccugguggguaaagcaccgggucgcuacaaccugcaucuuggcggcaaccgcauugggaca

SEQ ID NO: 4250167 - RNA, 71 nt, Shigella flexneri 2a str. 301; identical to SEQ ID NO: 4249203

SEQ ID NO: 4250168 - RNA, 58 nt, Shigella flexneri 2a str. 301; identical to SEQ ID NO: 4249437

SEQ ID NO: 4250169 - RNA, 55 nt, Shigella flexneri 2a str. 301; identical to SEQ ID NO: 4227215

SEQ ID NO: 4250170 - RNA, 86 nt, Shigella flexneri 2a str. 301; identical to SEQ ID NO: 4249228

SEQ ID NO: 4250171 - RNA, 68 nt, Shigella flexneri 2a str. 301; identical to SEQ ID NO: 4248976

SEQ ID NO: 4250172 - RNA, 66 nt, Shigella flexneri 2a str. 301
ccaaugcgauuauucaccccacguuugcguaauucaugcgcaaagggcaacaggugauaaucgugg

SEQ ID NO: 4250173 - RNA, 86 nt, Shigella flexneri 2a str. 301
caggcgauggaauggagcgagaaaacccgcacaccgcauuguaauaccgagaaauguguggguugucugcuuuguggucacgucug

SEQ ID NO: 4250174 - RNA, 104 nt, Shigella flexneri 2a str. 301
gcccccgaacuggcgcgccgugauguaguaucauuucucggcgcgaguuauuuccgcgccguugaugauacauaucaauacgguuugucggcccgcggccuggc

SEQ ID NO: 4250175 - RNA, 80 nt, Shigella flexneri 2a str. 301; identical to SEQ ID NO: 4249036

SEQ ID NO: 4250176 - RNA, 58 nt, Shigella flexneri 2a str. 301; identical to SEQ ID NO: 4249613

SEQ ID NO: 4250177 - RNA, 67 nt, Shigella flexneri 2a str. 301
cguggugauguuguaugugaauccuagcgugauuggcgcguucacgaugauuacaaccguuuccgcg

SEQ ID NO: 4250178 - RNA, 105 nt, Shigella flexneri 2a str. 301; identical to SEQ ID NO: 4249591

SEQ ID NO: 4250179 - RNA, 77 nt, Shigella flexneri 2a str. 301; identical to SEQ ID NO: 4249356

SEQ ID NO: 4250180 - RNA, 73 nt, Shigella flexneri 2a str. 301
ggcauauuuuuuccuuaagcuuuaggaaguuuuuauuauuuacuuugggccuggagacaggaaaaauuaugcu

SEQ ID NO: 4250181 - RNA, 81 nt, Shigella flexneri 2a str. 301
ggcucgaaucagggacuggaaacccgugccaugcuggagauuauuauccagcaggccacaguuccggugguugucgaugcu

SEQ ID NO: 4250182 - RNA, 85 nt, Shigella flexneri 2a str. 301; identical to SEQ ID NO: 4249314

SEQ ID NO: 4250183 - RNA, 79 nt, Shigella flexneri 2a str. 301
gugcugcgcugaugcgccaugaguuuauuuuaccuuauccgccgacggugaauacuuacuggcgacgucguggcagcac

SEQ ID NO: 4250184 - RNA, 83 nt, Shigella flexneri 2a str. 301
gggcaucugaccaaagcgugauagcggguuuacucauuauguccucggcaauaaagggggcuggcuaucaaacuauagagccu

SEQ ID NO: 4250185 - RNA, 67 nt, Shigella flexneri 2a str. 301
gcguauugugaggauaucaaaaugacaccuuuaguuaaggauaucaucaugucuucaacacguaugc

SEQ ID NO: 4250186 - RNA, 105 nt, Shigella flexneri 2a str. 301; identical to SEQ ID NO: 4248762

SEQ ID NO: 4250187 - RNA, 71 nt, Shigella flexneri 2a str. 301; identical to SEQ ID NO: 4249174

SEQ ID NO: 4250188 - RNA, 59 nt, Shigella flexneri 2a str. 301; identical to SEQ ID NO: 4228274

SEQ ID NO: 4250189 - RNA, 88 nt, Shigella flexneri 2a str. 301
ugccuucauuucacgucuaguuguuguauuugaaugcaaaauaaugccacauacaaaugccauuauugacgauaacaugauggaggca

SEQ ID NO: 4250190 - RNA, 84 nt, Shigella flexneri 2a str. 301
cggcaaagaauacgaggucaacggagcggacaaccugcuggaagcuugucugucucugggccuugauauuccuuacuuuugcug

SEQ ID NO: 4250191 - RNA, 79 nt, Shigella flexneri 2a str. 301
cucgcaccgccgcgauguacuuccgccaguugcuguuccagcgccccuuugcggcuggugguaucgcggucgauacgag

SEQ ID NO: 4250192 - RNA, 64 nt, Shigella flexneri 2a str. 301
ccaccggucgcgccauacaggcagguguugccgauaaugcuugcuucauggcugcggaaggcgg

SEQ ID NO: 4250193 - RNA, 80 nt, Shigella flexneri 2a str. 301
gcguaaacgccuuauccggccuacaaauucugcaaauucaacaaauugcgaaucccuuguaggccugauaagcguagcgc

SEQ ID NO: 4250194 - RNA, 64 nt, Shigella flexneri 2a str. 301; identical to SEQ ID NO: 4227144

SEQ ID NO: 4250195 - RNA, 89 nt, Shigella flexneri 2a str. 301
gguuaaucugcugguucgcggaauguguucgcugauccccaaucuggaaggcauuagcgacaacauucgugccaucaguauuguugacc

SEQ ID NO: 4250196 - RNA, 85 nt, Shigella flexneri 2a str. 301
uagugauugcauauaagauugugaaugacggccggaauagaucauguccugccacuguuucaccauccccagauagcgguuauug

SEQ ID NO: 4250197 - RNA, 57 nt, Shigella flexneri 2a str. 301
aauuuuauccaguaaugccuggcgcucggaagguuccaggaauugcaggguaaaauu

SEQ ID NO: 4250198 - RNA, 67 nt, Shigella flexneri 2a str. 301; identical to SEQ ID NO: 4249495

SEQ ID NO: 4250199 - RNA, 55 nt, Shigella flexneri 2a str. 301
gauugcgacucuggucgugggacugaccuuuauguucgcgaccuucauugcgguc

SEQ ID NO: 4250200 - RNA, 56 nt, Shigella flexneri 2a str. 301
ugccguauuucguaccggcaacgcuccggcuauuuugcagguuuaugaaguuggca

SEQ ID NO: 4250201 - RNA, 106 nt, Shigella flexneri 2a str. 301
ggccguggaaguucacguuggcaccggaaagaauaugcgccagccguucgccgcgaauguugugcugggcgauauauuuuuucauucccgccagcgccagcgcgcc

SEQ ID NO: 4250202 - RNA, 57 nt, Shigella flexneri 2a str. 301; identical to SEQ ID NO: 4249282

SEQ ID NO: 4250203 - RNA, 65 nt, Shigella flexneri 2a str. 301; identical to SEQ ID NO: 4249008

SEQ ID NO: 4250204 - RNA, 70 nt, Shigella flexneri 2a str. 301; identical to SEQ ID NO: 4248870

SEQ ID NO: 4250205 - RNA, 65 nt, Shigella flexneri 2a str. 301; identical to SEQ ID NO: 4249101

SEQ ID NO: 4250206 - RNA, 98 nt, Shigella flexneri 2a str. 301; identical to SEQ ID NO: 4249718

SEQ ID NO: 4250207 - RNA, 68 nt, Shigella flexneri 2a str. 301
uaccggugcgcuggcggugauguguauggcgaaagucuauggcgucacguuccucggcgcgccgcgua

SEQ ID NO: 4250208 - RNA, 67 nt, Shigella flexneri 2a str. 301; identical to SEQ ID NO: 4248876

SEQ ID NO: 4250209 - RNA, 57 nt, Shigella flexneri 2a str. 301; identical to SEQ ID NO: 4248902

SEQ ID NO: 4250210 - RNA, 90 nt, Shigella flexneri 2a str. 301; identical to SEQ ID NO: 4249531

SEQ ID NO: 4250211 - RNA, 69 nt, Shigella flexneri 2a str. 301; identical to SEQ ID NO: 4248886

SEQ ID NO: 4250212 - RNA, 57 nt, Shigella flexneri 2a str. 301; identical to SEQ ID NO: 4227354

SEQ ID NO: 4250213 - RNA, 68 nt, Shigella flexneri 2a str. 301
gccuuauccggccuacaaaaucgugcaaauucaauauauugcaaucaucuuguaggccugauaagugu

SEQ ID NO: 4250214 - RNA, 113 nt, Shigella flexneri 2a str. 301; identical to SEQ ID NO: 4249168

SEQ ID NO: 4250215 - RNA, 71 nt, Shigella flexneri 2a str. 301
gcagugaugugauugucugcgcugaaauggacgaacauuggggcuacgucggugcuaaaucacgucagcgc

SEQ ID NO: 4250216 - RNA, 65 nt, Shigella flexneri 2a str. 301
cgguuuuuaguacugcaauccugauuauuccuugcgucuggcucggaauugccgugcaaaauccg

SEQ ID NO: 4250217 - RNA, 63 nt, Shigella flexneri 2a str. 301; identical to SEQ ID NO: 4245936

SEQ ID NO: 4250218 - RNA, 78 nt, Shigella flexneri 2a str. 301
uugcagacaaagugagcuuuguucaugccggaugcggcguaaacgcccaauccggccuacaaauucaauaaauugcag

SEQ ID NO: 4250219 - RNA, 90 nt, Shigella flexneri 2a str. 301; identical to SEQ ID NO: 4249331

SEQ ID NO: 4250220 - RNA, 117 nt, Shigella flexneri 2a str. 301; identical to SEQ ID NO: 4249513

SEQ ID NO: 4250221 - RNA, 77 nt, Shigella flexneri 2a str. 301; identical to SEQ ID NO: 4227673

SEQ ID NO: 4250222 - RNA, 59 nt, Shigella flexneri 2a str. 301
uauuuuuaaucagguggaaaccggccaggccgacuaugccgucguaccgauugaaaaua

SEQ ID NO: 4250223 - RNA, 63 nt, Shigella flexneri 2a str. 301; identical to SEQ ID NO: 4249374

SEQ ID NO: 4250224 - RNA, 70 nt, Shigella flexneri 2a str. 301
ccgacacagcugcugaugcugacagauaagcaaaucgccgauuuccagaaacauuaucagacugaagcgg

SEQ ID NO: 4250225 - RNA, 129 nt, Shigella flexneri 2a str. 301
gguaaccucgcgcauacaaccgggcagugaugugauugucugcgcugaaauggacgaacauuggggcuacgucggugcuaaaucacgucagcgcuggcuguuuuacgcgugugacaggauacggaggac

SEQ ID NO: 4250226 - RNA, 107 nt, Shigella flexneri 2a str. 301; identical to SEQ ID NO: 4249253

SEQ ID NO: 4250227 - RNA, 71 nt, Shigella flexneri 2a str. 301; identical to SEQ ID NO: 4249605

SEQ ID NO: 4250228 - RNA, 71 nt, Shigella flexneri 2a str. 301
ugcgcuacugugacgaaaaccuuuaauuguuuuaaagaauaauucaucuguuuucuucaugaauggaugca

SEQ ID NO: 4250229 - RNA, 85 nt, Shigella flexneri 2a str. 301; identical to SEQ ID NO: 4249505

SEQ ID NO: 4250230 - RNA, 61 nt, Shigella flexneri 2a str. 301; identical to SEQ ID NO: 4249496

SEQ ID NO: 4250231 - RNA, 56 nt, Shigella flexneri 2a str. 301
ggcgcuggguuuccggaucgauguuguggcagcgagcgucgaucagcuccagcgcc

SEQ ID NO: 4250232 - RNA, 58 nt, Shigella flexneri 2a str. 301
gugcuuguugugaaaugccggaugcggcguaaacgccuuauccggccuacaaaagcau

SEQ ID NO: 4250233 - RNA, 63 nt, Shigella flexneri 2a str. 301
cuucucaggccuacaaaaucuugcaaauucaauauauugcaaucuccguguaggccugauaag

SEQ ID NO: 4250234 - RNA, 77 nt, Shigella flexneri 2a str. 301
uccggcguggcuuucagaaugguggcgcacagggcaggggucaggcucauugccacaaauacugaaagccgcaugga

SEQ ID NO: 4250235 - RNA, 63 nt, Shigella flexneri 2a str. 301
ucggauggguggcgaugauauuuuccagcuccacgcaggagacauucucgccaccgcguuuga

SEQ ID NO: 4250236 - RNA, 64 nt, Shigella flexneri 2a str. 301
ccgccagaacuggcgaaacuagggauaacggaacuggaguaugaguuuuaccgucggcuggugg

SEQ ID NO: 4250237 - RNA, 74 nt, Shigella flexneri 2a str. 301; identical to SEQ ID NO: 4249539

SEQ ID NO: 4250238 - RNA, 86 nt, Shigella flexneri 2a str. 301; identical to SEQ ID NO: 4248894

SEQ ID NO: 4250239 - RNA, 76 nt, Shigella flexneri 2a str. 301; identical to SEQ ID NO: 4249492

SEQ ID NO: 4250240 - RNA, 79 nt, Shigella flexneri 2a str. 301
acagcggaaaccaggguagccaguuuuuucauguucauauucaagauguccuguagucguuauuacugcuuuuuguugu

SEQ ID NO: 4250241 - RNA, 71 nt, Shigella flexneri 2a str. 301; identical to SEQ ID NO: 4249688

SEQ ID NO: 4250242 - RNA, 66 nt, Shigella flexneri 2a str. 301; identical to SEQ ID NO: 4249456

SEQ ID NO: 4250243 - RNA, 57 nt, Shigella flexneri 2a str. 301
ggcguucuuuaucgccaagcgucuacgaucuaacguacgugagcuggaaggggcgcu

SEQ ID NO: 4250244 - RNA, 85 nt, Shigella flexneri 2a str. 301
guuccgcuguuuuucuccgguaaggcugcgauaauuacaucaauggcgcgaugcgauuucggcgcauugccgggagcagaggaac

SEQ ID NO: 4250245 - RNA, 110 nt, Shigella flexneri 2a str. 301; identical to SEQ ID NO: 4248766

SEQ ID NO: 4250246 - RNA, 58 nt, Shigella flexneri 2a str. 301
ggauugacuggcauugcguagcugugaacaaaguaaaaguacgcgccgucuucaaucc

SEQ ID NO: 4250247 - RNA, 92 nt, Shigella flexneri 2a str. 301; identical to SEQ ID NO: 4249112

SEQ ID NO: 4250248 - RNA, 66 nt, Shigella flexneri 2a str. 301
accauaucaucacaaguggucagaccuccuacaaguaaggggcuuuucguuaugaugauuuugagu

SEQ ID NO: 4250249 - RNA, 69 nt, Shigella flexneri 2a str. 301; identical to SEQ ID NO: 4249482

SEQ ID NO: 4250250 - RNA, 79 nt, Shigella flexneri 2a str. 301; identical to SEQ ID NO: 4249598

SEQ ID NO: 4250251 - RNA, 57 nt, Shigella flexneri 2a str. 301; identical to SEQ ID NO: 4249449

SEQ ID NO: 4250252 - RNA, 102 nt, Shigella flexneri 2a str. 301
aggcauucagaaaccguuccucgccauuuucgucuggaccgugguguucucgcugaucacugucuuuuuaacgguggcggucggcaugguucuggcaugucu

SEQ ID NO: 4250253 - RNA, 96 nt, Shigella flexneri 2a str. 301; identical to SEQ ID NO: 4249137

SEQ ID NO: 4250254 - RNA, 94 nt, Shigella flexneri 2a str. 301
gcagucuguucggcauguuggcagcgaaucggcguuggcgcggcaacaccaaaugccaggcguaauucgcugaaauugccguuauccagucggc

SEQ ID NO: 4250255 - RNA, 81 nt, Shigella flexneri 2a str. 301; identical to SEQ ID NO: 4249294

SEQ ID NO: 4250256 - RNA, 56 nt, Shigella flexneri 2a str. 301
uucuuguaguuucaacgcugcggcaacagcugcuccagaagagauaccugcaagaa

SEQ ID NO: 4250257 - RNA, 61 nt, Shigella flexneri 2a str. 301
aagagcgucucucuucgcgucagugugcggcauucguuucgggcguggugaaagaugccuu

SEQ ID NO: 4250258 - RNA, 66 nt, Shigella flexneri 2a str. 301
ugaugguguugaaguucgucauaucguuggcgcgauugcuaacgaaggcgacaucagcagccguua

SEQ ID NO: 4250259 - RNA, 74 nt, Shigella flexneri 2a str. 301; identical to SEQ ID NO: 4249147

SEQ ID NO: 4250260 - RNA, 66 nt, Shigella flexneri 2a str. 301; identical to SEQ ID NO: 4249078

SEQ ID NO: 4250261 - RNA, 87 nt, Shigella flexneri 2a str. 301; identical to SEQ ID NO: 4249173

SEQ ID NO: 4250262 - RNA, 99 nt, Shigella flexneri 2a str. 301; identical to SEQ ID NO: 4249583

SEQ ID NO: 4250263 - RNA, 90 nt, Shigella flexneri 2a str. 301
ugcguucuaucaggcucuugucgagcucgguggaacugcccaccagcgucaguucuaccugcuugccgaguuuucccgccagaucacgca

SEQ ID NO: 4250264 - RNA, 71 nt, Shigella flexneri 2a str. 301
augcuggcaggcuguaaauuauugcaaggucguuaucgacuacuggcggugguuggcgggcuguuaugcgu

SEQ ID NO: 4250265 - RNA, 86 nt, Shigella flexneri 2a str. 301
gcugaaaauugcugagcagcauaauauuucgcgcagugcgacagaugugccugccgaggaauuaccugauucagaaauguuccugc

SEQ ID NO: 4250266 - RNA, 69 nt, Shigella flexneri 2a str. 301; identical to SEQ ID NO: 4249130

SEQ ID NO: 4250267 - RNA, 62 nt, Shigella flexneri 2a str. 301; identical to SEQ ID NO: 4249180

SEQ ID NO: 4250268 - RNA, 62 nt, Shigella flexneri 2a str. 301
gguugaaggauugcaggaacugguuauucaggcugauauccauccgcgaacugucuuucacc

SEQ ID NO: 4250269 - RNA, 92 nt, Shigella flexneri 2a str. 301; identical to SEQ ID NO: 4249681

SEQ ID NO: 4250270 - RNA, 65 nt, Shigella flexneri 2a str. 301
auguagccgucaaguugucauaauugguaacgaaucagacaauugacggcuugacggaguagcau

SEQ ID NO: 4250271 - RNA, 79 nt, Shigella flexneri 2a str. 301; identical to SEQ ID NO: 4228444

SEQ ID NO: 4250272 - RNA, 97 nt, Shigella flexneri 2a str. 301; identical to SEQ ID NO: 4249589

SEQ ID NO: 4250273 - RNA, 72 nt, Shigella flexneri 2a str. 301; identical to SEQ ID NO: 4249588

SEQ ID NO: 4250274 - RNA, 102 nt, Shigella flexneri 2a str. 301; identical to SEQ ID NO: 4248798

SEQ ID NO: 4250275 - RNA, 88 nt, Shigella flexneri 2a str. 301; identical to SEQ ID NO: 4248761

SEQ ID NO: 4250276 - RNA, 76 nt, Shigella flexneri 2a str. 301
uuguuacccgcagcgauuguugccguagaggugaacacgcccaucaccauugccgcagcaauagcuguuuuaacaa

SEQ ID NO: 4250277 - RNA, 59 nt, Shigella flexneri 2a str. 301; identical to SEQ ID NO: 4227875

SEQ ID NO: 4250278 - RNA, 80 nt, Shigella flexneri 2a str. 301
ugcgcguggcgcguuuuuucuuccgucaaaauguagaaggcgacuuucugcgcaucaaaaagauaaaaggcauuagcgca

SEQ ID NO: 4250279 - RNA, 61 nt, Shigella flexneri 2a str. 301; identical to SEQ ID NO: 4249084

SEQ ID NO: 4250280 - RNA, 68 nt, Shigella flexneri 2a str. 301
ccgacguagcugaagucgcccuucuuguucaucuccucgagcauggcgauguguuucaccugcuccgg

SEQ ID NO: 4250281 - RNA, 67 nt, Shigella flexneri 2a str. 301; identical to SEQ ID NO: 4249175

SEQ ID NO: 4250282 - RNA, 69 nt, Shigella flexneri 2a str. 301; identical to SEQ ID NO: 4248801

SEQ ID NO: 4250283 - RNA, 90 nt, Shigella flexneri 2a str. 301
gaugcgcuacgcuuaucaggccuacacggagauugcaauauauugaauuugcaagauuuuguaggccugagaagguguucaugccgcauc

SEQ ID NO: 4250284 - RNA, 66 nt, Shigella flexneri 2a str. 301; identical to SEQ ID NO: 4228243

SEQ ID NO: 4250285 - RNA, 59 nt, Shigella flexneri 2a str. 301; identical to SEQ ID NO: 4227874

SEQ ID NO: 4250286 - RNA, 56 nt, Shigella flexneri 2a str. 301; identical to SEQ ID NO: 4228131

SEQ ID NO: 4250287 - RNA, 85 nt, Shigella flexneri 2a str. 301
aagcgcggcgcgaugccgcuuacucaagaagaaagaauuaugacguugucuccuuauuugaaagagguggcgaagcgccgcacuu

SEQ ID NO: 4250288 - RNA, 86 nt, Shigella flexneri 2a str. 301; identical to SEQ ID NO: 4249557

SEQ ID NO: 4250289 - RNA, 58 nt, Shigella flexneri 2a str. 301; identical to SEQ ID NO: 4249507

SEQ ID NO: 4250290 - RNA, 82 nt, Shigella flexneri 2a str. 301; identical to SEQ ID NO: 4249597

SEQ ID NO: 4250291 - RNA, 61 nt, Shigella flexneri 2a str. 301; identical to SEQ ID NO: 4249480

SEQ ID NO: 4250292 - RNA, 76 nt, Shigella flexneri 2a str. 301
guguuggggacgggcgaaaagccagcguggcauuuuauaccagauguuaccgccggauuuacgccggaaccuucgc

SEQ ID NO: 4250293 - RNA, 81 nt, Shigella flexneri 2a str. 301
acguuauacgcugguuuauuuugauaccguugaugagaucaaagaucgggugaauugauuaaaaauaagccagauggacgu

SEQ ID NO: 4250294 - RNA, 55 nt, Shigella flexneri 2a str. 301; identical to SEQ ID NO: 4249128

SEQ ID NO: 4250295 - RNA, 65 nt, Shigella flexneri 2a str. 301; identical to SEQ ID NO: 4227145

SEQ ID NO: 4250296 - RNA, 55 nt, Shigella flexneri 2a str. 301; identical to SEQ ID NO: 4248783

SEQ ID NO: 4250297 - RNA, 75 nt, Shigella flexneri 2a str. 301
gugccgaacuggcgggggagaaugaagguaucgaucacaaggugauagaugcguuuucacccgcuggcugagcgc

SEQ ID NO: 4250298 - RNA, 91 nt, Shigella flexneri 2a str. 301; identical to SEQ ID NO: 4249298

SEQ ID NO: 4250299 - RNA, 75 nt, Shigella flexneri 2a str. 301
cuuucgccaucuugauugcagccagaguuucggucagagaaccgaucugguugaauuugaucaggauggaguuag

SEQ ID NO: 4250300 - RNA, 72 nt, Shigella flexneri 2a str. 301
gccguuuuuucgccacgccaauggucggcacauccaccaauaagccaaaauggcuggcgacgccaagacggc

SEQ ID NO: 4250301 - RNA, 79 nt, Shigella flexneri 2a str. 301; identical to SEQ ID NO: 4228472

SEQ ID NO: 4250302 - RNA, 61 nt, Shigella flexneri 2a str. 301; identical to SEQ ID NO: 4248887

SEQ ID NO: 4250303 - RNA, 56 nt, Shigella flexneri 2a str. 301; identical to SEQ ID NO: 4249556

SEQ ID NO: 4250304 - RNA, 57 nt, Shigella flexneri 2a str. 301
ggucugguuauccgucgcaaucugcuguuuaugcugauuggucuggaaaucaugauu

SEQ ID NO: 4250305 - RNA, 58 nt, Shigella flexneri 2a str. 301
gcugauuucccagugacaacauaggcguacguaacguuauguguugugggaaacucgc

SEQ ID NO: 4250306 - RNA, 56 nt, Shigella flexneri 2a str. 301; identical to SEQ ID NO: 4249631

SEQ ID NO: 4250307 - RNA, 77 nt, Shigella flexneri 2a str. 301
ucgagucgaacuggagcgggcguugaguaaucaugaaaaugauaaccagcagcagcguauucaguuugagcaggcga

SEQ ID NO: 4250308 - RNA, 92 nt, Shigella flexneri 2a str. 301; identical to SEQ ID NO: 4249576

SEQ ID NO: 4250309 - RNA, 65 nt, Shigella flexneri 2a str. 301; identical to SEQ ID NO: 4249342

SEQ ID NO: 4250310 - RNA, 58 nt, Shigella flexneri 2a str. 301; identical to SEQ ID NO: 4227764

SEQ ID NO: 4250311 - RNA, 73 nt, Shigella flexneri 2a str. 301
gguaguaucggugguguauuccgcaucgguguaaguauaagaaccgacuacguuaacacucgccgacagcgcc

SEQ ID NO: 4250312 - RNA, 92 nt, Shigella flexneri 2a str. 301; identical to SEQ ID NO: 4248822

SEQ ID NO: 4250313 - RNA, 63 nt, Shigella flexneri 2a str. 301; identical to SEQ ID NO: 4248910

SEQ ID NO: 4250314 - RNA, 63 nt, Shigella flexneri 2a str. 301; identical to SEQ ID NO: 4228571

SEQ ID NO: 4250315 - RNA, 129 nt, Shigella flexneri 2a str. 301; identical to SEQ ID NO: 4248874

SEQ ID NO: 4250316 - RNA, 71 nt, Shigella flexneri 2a str. 301
gcguacccguugacuguuugucaaagaaugaaacuggcauucccaucaugugaccaaacaggcggcgacgc

SEQ ID NO: 4250317 - RNA, 58 nt, Shigella flexneri 2a str. 301; identical to SEQ ID NO: 4249335

SEQ ID NO: 4250318 - RNA, 89 nt, Shigella flexneri 2a str. 301
gcaaggaagggaggaaacuuauuucuuaucguucugcgggaacuucauuucgcuguagcguacgaagugaguuccuuuaaucagcuugu

SEQ ID NO: 4250319 - RNA, 64 nt, Shigella flexneri 2a str. 301; identical to SEQ ID NO: 4248978

SEQ ID NO: 4250320 - RNA, 64 nt, Shigella flexneri 2a str. 301; identical to SEQ ID NO: 4248791

SEQ ID NO: 4250321 - RNA, 83 nt, Shigella flexneri 2a str. 301
cauuuuucaccgucaugaugucuucagauuguuuuuccggaucgguaugaaagcucguaacaucaaugauaucgucaaaagug

SEQ ID NO: 4250322 - RNA, 63 nt, Shigella flexneri 2a str. 301; identical to SEQ ID NO: 4249425

SEQ ID NO: 4250323 - RNA, 80 nt, Shigella flexneri 2a str. 301
cgcacugcauaagucgguacgugguagcgcacccgaugcggcgcuguacugguaugcgcgaauuauuaccgcugguggcg

SEQ ID NO: 4250324 - RNA, 64 nt, Shigella flexneri 2a str. 301; identical to SEQ ID NO: 4249651

SEQ ID NO: 4250325 - RNA, 65 nt, Shigella flexneri 2a str. 301; identical to SEQ ID NO: 4248942

SEQ ID NO: 4250326 - RNA, 79 nt, Shigella flexneri 2a str. 301; identical to SEQ ID NO: 4249250

SEQ ID NO: 4250327 - RNA, 60 nt, Shigella flexneri 2a str. 301; identical to SEQ ID NO: 4227981

SEQ ID NO: 4250328 - RNA, 63 nt, Shigella flexneri 2a str. 301; identical to SEQ ID NO: 4249145

SEQ ID NO: 4250329 - RNA, 58 nt, Shigella flexneri 2a str. 301
ugaugccagguuguuucaucccacagcucaaacuuguugaacuguccaaccagcauca

SEQ ID NO: 4250330 - RNA, 121 nt, Shigella flexneri 2a str. 301
auaguuguuuacugugcgcuguuguccaugugauauuguguaccagauguguaccaaaccauuauuucugagcguaccaaauauuauuuauggcuauaagcgacacaaaacugcguacuau

SEQ ID NO: 4250331 - RNA, 61 nt, Shigella flexneri 2a str. 301
uucgucgucgauauagcuacggaauacggcgucaucuucguauuccugcggaucgagagaa

SEQ ID NO: 4250332 - RNA, 58 nt, Shigella flexneri 2a str. 301
gcggcgagugccugcgggugaacuaucgcgaaugugagcaccugggcggcuugccugc

SEQ ID NO: 4250333 - RNA, 64 nt, Shigella flexneri 2a str. 301; identical to SEQ ID NO: 4249249

SEQ ID NO: 4250334 - RNA, 76 nt, Shigella flexneri 2a str. 301; identical to SEQ ID NO: 4249614

SEQ ID NO: 4250335 - RNA, 58 nt, Shigella flexneri 2a str. 301; identical to SEQ ID NO: 4249413

SEQ ID NO: 4250336 - RNA, 57 nt, Shigella flexneri 2a str. 301
aauaugcugcaacccggcgugucgaaauaugauuuugcggcgggccguagccauauu

SEQ ID NO: 4250337 - RNA, 62 nt, Shigella flexneri 2a str. 301; identical to SEQ ID NO: 4249227

SEQ ID NO: 4250338 - RNA, 73 nt, Shigella flexneri 2a str. 301; identical to SEQ ID NO: 4249192

SEQ ID NO: 4250339 - RNA, 57 nt, Shigella flexneri 2a str. 301; identical to SEQ ID NO: 4227248

SEQ ID NO: 4250340 - RNA, 101 nt, Shigella flexneri 2a str. 301; identical to SEQ ID NO: 4249019

SEQ ID NO: 4250341 - RNA, 83 nt, Shigella flexneri 2a str. 301; identical to SEQ ID NO: 4249436

SEQ ID NO: 4250342 - RNA, 63 nt, Shigella flexneri 2a str. 301
gcacggcugagagcaccaccagagaacauguuaaacaucucaaugauggugccucgcuguugc

SEQ ID NO: 4250343 - RNA, 61 nt, Shigella flexneri 2a str. 301; identical to SEQ ID NO: 4249229

SEQ ID NO: 4250344 - RNA, 75 nt, Shigella flexneri 2a str. 301
uacgccgaauuaauacagucuugccugaugcgacgcuggcgcgucuuaucaggcuugggcaguguuagaaccgua

SEQ ID NO: 4250345 - RNA, 62 nt, Shigella flexneri 2a str. 301; identical to SEQ ID NO: 4248835

SEQ ID NO: 4250346 - RNA, 85 nt, Shigella flexneri 2a str. 301; identical to SEQ ID NO: 4249636

SEQ ID NO: 4250347 - RNA, 82 nt, Shigella flexneri 2a str. 301
ggugcgcccacgggcaggcgagugaaacauagagaugauaacgaucuuucucugcgauaaaaccgccugugccaguggggcc

SEQ ID NO: 4250348 - RNA, 79 nt, Shigella flexneri 2a str. 301; identical to SEQ ID NO: 4249611

SEQ ID NO: 4250349 - RNA, 97 nt, Shigella flexneri 2a str. 301; identical to SEQ ID NO: 4227694

SEQ ID NO: 4250350 - RNA, 75 nt, Shigella flexneri 2a str. 301; identical to SEQ ID NO: 4249222

SEQ ID NO: 4250351 - RNA, 68 nt, Shigella flexneri 2a str. 301; identical to SEQ ID NO: 4248769

SEQ ID NO: 4250352 - RNA, 99 nt, Shigella flexneri 2a str. 301
gaguggccuuaggugcgacucgcguaauuuauccggcagggcaaaaacaagugcaacuugccgugacaaauaaugaugaaaauaguaccuauuuaauuc

SEQ ID NO: 4250353 - RNA, 64 nt, Shigella flexneri 2a str. 301; identical to SEQ ID NO: 4249359

SEQ ID NO: 4250354 - RNA, 68 nt, Shigella flexneri 2a str. 301; identical to SEQ ID NO: 4249535

SEQ ID NO: 4250355 - RNA, 74 nt, Shigella flexneri 2a str. 301
cucagaaagaaggcuggcgucguccgguaaagaaaaaguaauucuggccggguaauccggucaucugggaugag

SEQ ID NO: 4250356 - RNA, 58 nt, Shigella flexneri 2a str. 301
uacguggaugcuucccguaucguuaucaaaguuaacgaagacgagauguauccgggug

SEQ ID NO: 4250357 - RNA, 82 nt, Shigella flexneri 2a str. 301
ugcagaucaucguaaccgacgacgguuuacagcauuaccgucuggcgcgugauguggaaauugucguuauugauggugugcg

SEQ ID NO: 4250358 - RNA, 66 nt, Shigella flexneri 2a str. 301; identical to SEQ ID NO: 4249028

SEQ ID NO: 4250359 - RNA, 107 nt, Shigella flexneri 2a str. 301
cggcauugggcugguguuugguaucguugggcugguguugcuacugguucaggcgguggaucucaaugccagcgccacagcgauaaccaguuacagccucuauggcg

SEQ ID NO: 4250360 - RNA, 69 nt, Shigella flexneri 2a str. 301; identical to SEQ ID NO: 4249575

SEQ ID NO: 4250361 - RNA, 57 nt, Shigella flexneri 2a str. 301; identical to SEQ ID NO: 4249445

SEQ ID NO: 4250362 - RNA, 87 nt, Shigella flexneri 2a str. 301; identical to SEQ ID NO: 4248832

SEQ ID NO: 4250363 - RNA, 55 nt, Shigella flexneri 2a str. 301; identical to SEQ ID NO: 4249621

SEQ ID NO: 4250364 - RNA, 58 nt, Shigella flexneri 2a str. 301
ggcauguucccaagccagaugucgcuggaugaaggcgggcgucuggaagaagaacgcc

SEQ ID NO: 4250365 - RNA, 60 nt, Shigella flexneri 2a str. 301; identical to SEQ ID NO: 4227980

SEQ ID NO: 4250366 - RNA, 71 nt, Shigella flexneri 2a str. 301
uccccaguaauaugauguuagcgaaaauuggcgcucgucgauggaucgcugggaucaugguggucugggga

SEQ ID NO: 4250367 - RNA, 56 nt, Shigella flexneri 2a str. 301
ggcuauuacggcgguaaagucgaucucugggggcaacgcuuuauugaaguaugguc

SEQ ID NO: 4250368 - RNA, 59 nt, Shigella flexneri 2a str. 301; identical to SEQ ID NO: 4249403

SEQ ID NO: 4250369 - RNA, 69 nt, Shigella flexneri 2a str. 301
ggcgcugggucugguaguugccgccgcaggguuacaguuccaggcggcgcuacagcacccauacgugcu

SEQ ID NO: 4250370 - RNA, 87 nt, Shigella flexneri 2a str. 301
gcuauggcagcagcgaugcaggcacaccgcuaugaucugcaauaucagcuuuauacccuggcgcugcaucguuaucugcgccaucgc

SEQ ID NO: 4250371 - RNA, 85 nt, Shigella flexneri 2a str. 301; identical to SEQ ID NO: 4249033

SEQ ID NO: 4250372 - RNA, 56 nt, Shigella flexneri 2a str. 301
cugaauuugucguucagccagaauucgcgucugcucugcuucacgacgacguucag

SEQ ID NO: 4250373 - RNA, 60 nt, Shigella flexneri 2a str. 301
ggauggaaaucgcgcuggucgauuacuguuucaaaguguuaaucaguaucguuuucuucc

SEQ ID NO: 4250374 - RNA, 104 nt, Shigella flexneri 2a str. 301; identical to SEQ ID NO: 4249423

SEQ ID NO: 4250375 - RNA, 62 nt, Shigella flexneri 2a str. 301
uuugccgucggagaggaaaucgaucucuucaucagggaaaucaauugccgcuucgacguaaa

SEQ ID NO: 4250376 - RNA, 81 nt, Shigella flexneri 2a str. 301
cgucuggcggcgcuguuggcuaaguuugcgguauuguugcggcgacaugccgacauauuugccgaacgugcuguaaaaacg

SEQ ID NO: 4250377 - RNA, 62 nt, Shigella flexneri 2a str. 301; identical to SEQ ID NO: 4249230

SEQ ID NO: 4250378 - RNA, 63 nt, Shigella flexneri 2a str. 301
agcaguuguuauuaaaggauacccuuuuuacgaggguaucccuucagacugauaacaaacgcu

SEQ ID NO: 4250379 - RNA, 72 nt, Shigella flexneri 2a str. 301; identical to SEQ ID NO: 4249357

SEQ ID NO: 4250380 - RNA, 96 nt, Shigella flexneri 2a str. 301; identical to SEQ ID NO: 4249226

SEQ ID NO: 4250381 - RNA, 94 nt, Shigella flexneri 2a str. 301; identical to SEQ ID NO: 4249238

SEQ ID NO: 4250382 - RNA, 57 nt, Shigella flexneri 2a str. 301
gcucaggucguuagucacaucgcccgcagauagcggagaugugccuuuagacucagc

SEQ ID NO: 4250383 - RNA, 75 nt, Shigella flexneri 2a str. 301; identical to SEQ ID NO: 4249475

SEQ ID NO: 4250384 - RNA, 88 nt, Shigella flexneri 2a str. 301
agcggaauauugcgaccgcaucggccugguguaccgugggaaauuaaucgccagcgguacgccggacgauuugaaagcacagucagcu

SEQ ID NO: 4250385 - RNA, 85 nt, Shigella flexneri 2a str. 301
ucugaccagcuuucguagucgccgauaccgagguagcgggucagcucgcccagcgcuucgguauggcgggugcucuccugacgga

SEQ ID NO: 4250386 - RNA, 85 nt, Shigella flexneri 2a str. 301; identical to SEQ ID NO: 4249212

SEQ ID NO: 4250387 - RNA, 55 nt, Shigella flexneri 2a str. 301; identical to SEQ ID NO: 4249211

SEQ ID NO: 4250388 - RNA, 56 nt, Shigella flexneri 2a str. 301; identical to SEQ ID NO: 4249375

SEQ ID NO: 4250389 - RNA, 55 nt, Shigella flexneri 2a str. 301
uagccgcugaccacuaccugggaggagucgccuacucccagggugucgagcgcua

SEQ ID NO: 4250390 - RNA, 59 nt, Shigella flexneri 2a str. 301; identical to SEQ ID NO: 4249626

SEQ ID NO: 4250391 - RNA, 72 nt, Shigella flexneri 2a str. 301; identical to SEQ ID NO: 4249039

SEQ ID NO: 4250392 - RNA, 70 nt, Shigella flexneri 2a str. 301; identical to SEQ ID NO: 4249392

SEQ ID NO: 4250393 - RNA, 63 nt, Shigella flexneri 2a str. 301
gcgcugcgucuggcauuaggaacgcugauccucaucgcguucuuuaagccauggcgacugcgc

SEQ ID NO: 4250394 - RNA, 61 nt, Shigella flexneri 2a str. 301; identical to SEQ ID NO: 4249055

SEQ ID NO: 4250395 - RNA, 76 nt, Shigella flexneri 2a str. 301
gguuucggcuucgucauuccgaaaggcuaccuguacgcugccauugguuucucggugaugaucgaggcacucaauc

SEQ ID NO: 4250396 - RNA, 81 nt, Shigella flexneri 2a str. 301; identical to SEQ ID NO: 4249371

SEQ ID NO: 4250397 - RNA, 96 nt, Shigella flexneri 2a str. 301; identical to SEQ ID NO: 4227671

SEQ ID NO: 4250398 - RNA, 62 nt, Shigella flexneri 2a str. 301; identical to SEQ ID NO: 4227177

SEQ ID NO: 4250399 - RNA, 58 nt, Shigella flexneri 2a str. 301; identical to SEQ ID NO: 4249379

SEQ ID NO: 4250400 - RNA, 100 nt, Shigella flexneri 2a str. 301
gcgccccuggcuggcauuccggggcauuuugacggcgcgcuggaugugaaucugcaacagcccguuauguacgaaggccuggagccggaucaggggcugc

SEQ ID NO: 4250401 - RNA, 84 nt, Shigella flexneri 2a str. 301
acaacacgaaggcgcauuuccgguauccauaaagagucggucuugucugugaaauuuaaauggugggagugcgcuuccgguugu

SEQ ID NO: 4250402 - RNA, 62 nt, Shigella flexneri 2a str. 301
uaaucacaguagucgaaguuuuuuagcagcuuaacuuacugaaauuuaacuacugaugauug

SEQ ID NO: 4250403 - RNA, 63 nt, Shigella flexneri 2a str. 301
uggcauucagcagugccgguaaugcacuggcgacauucuguaccaccgguaagcugaauuuua

SEQ ID NO: 4250404 - RNA, 91 nt, Shigella flexneri 2a str. 301
gaucccggcggagauuuugcacaaccaacuggcgcguucaauagcaggcaacgcuucccauucugguugugcacguucugcugcaucgauu

SEQ ID NO: 4250405 - RNA, 66 nt, Shigella flexneri 2a str. 301
gcggccuacgucgcggaucaccgcuuucgccgccaucguaccgaaggugauaaucugcgauaccgc

SEQ ID NO: 4250406 - RNA, 69 nt, Shigella flexneri 2a str. 301; identical to SEQ ID NO: 4249103

SEQ ID NO: 4250407 - RNA, 57 nt, Shigella flexneri 2a str. 301
cgauuaucaccuguugcccuuugcgcaugaauuacgcaaacguggggugaauaaucg

SEQ ID NO: 4250408 - RNA, 77 nt, Shigella flexneri 2a str. 301; identical to SEQ ID NO: 4227952

SEQ ID NO: 4250409 - RNA, 90 nt, Shigella flexneri 2a str. 301
ucaaagcagcaaucucugccggacugaaaauugaugacuucgcuccucgccugucguuauucuucgguaucggcauggaucuguuuauga

SEQ ID NO: 4250410 - RNA, 77 nt, Shigella flexneri 2a str. 301; identical to SEQ ID NO: 4248927

SEQ ID NO: 4250411 - RNA, 129 nt, Shigella flexneri 2a str. 301
gcuuuggaaaccggcuuaacgauguuaucgaugugauagauuggauaagaaacgcggguguucucgguuuuugaaccaucaucaaagucgauagugccaucuucacgcacggugacguuuuccagcagc

SEQ ID NO: 4250412 - RNA, 57 nt, Shigella flexneri 2a str. 301; identical to SEQ ID NO: 4228379

SEQ ID NO: 4250413 - RNA, 63 nt, Shigella flexneri 2a str. 301; identical to SEQ ID NO: 4248854

SEQ ID NO: 4250414 - RNA, 106 nt, Shigella flexneri 2a str. 301; identical to SEQ ID NO: 4249113

SEQ ID NO: 4250415 - RNA, 57 nt, Shigella flexneri 2a str. 301; identical to SEQ ID NO: 4249476

SEQ ID NO: 4250416 - RNA, 59 nt, Shigella flexneri 2a str. 301; identical to SEQ ID NO: 4249716

SEQ ID NO: 4250417 - RNA, 91 nt, Shigella flexneri 2a str. 301; identical to SEQ ID NO: 4249665

SEQ ID NO: 4250418 - RNA, 92 nt, Shigella flexneri 2a str. 301
cgcaaacgguagaagacucggucacucaggugauugagcaaaauaugaaugggcuugauggccugauguacaugucuucaaccagugaugcg

SEQ ID NO: 4250419 - RNA, 130 nt, Shigella flexneri 2a str. 301
ggucggugagauucagcgucccguuuuccagcaggaugguaucgacauggcgugguucggucaguuggcgacugcuuagcgcaaugucgacacuuuuugccaccaggggcgcgggcugaccaucacgacc

SEQ ID NO: 4250420 - RNA, 68 nt, Shigella flexneri 2a str. 301
gucagcauaauggcaaagaucgccggaaccuguuuuuuuaaaguggauggucagcaguuaucgcugac

SEQ ID NO: 4250421 - RNA, 83 nt, Shigella flexneri 2a str. 301
agaccaguaaagugcgcuuuguuuaugccagaugcgacgcugacgcgucuuaucuggccuacaaagggcuaacgugcagguuu

SEQ ID NO: 4250422 - RNA, 74 nt, Shigella flexneri 2a str. 301
ucugguuuccuggguuguaucguuuauuccgcgccgcccggagcggagcgaaacggcacaaccaucggaucagg

SEQ ID NO: 4250423 - RNA, 55 nt, Shigella flexneri 2a str. 301
gcgacggaaagaaggcguuuucaacaggccagagaacagcccgguuuucaguugc

SEQ ID NO: 4250424 - RNA, 72 nt, Shigella flexneri 2a str. 301; identical to SEQ ID NO: 4248867

SEQ ID NO: 4250425 - RNA, 68 nt, Shigella flexneri 2a str. 301
cuggcuuugcccaacugacugaagguguccagcgaaaugagacgacgcagauccugggcgauuuccag

SEQ ID NO: 4250426 - RNA, 65 nt, Shigella flexneri 2a str. 301; identical to SEQ ID NO: 4248931

SEQ ID NO: 4250427 - RNA, 83 nt, Shigella flexneri 2a str. 301
auccacgcguacugaauguuguugguauccuggaauucguccaccaggauauugguaaaacguucgcgguaguguuguaggau

SEQ ID NO: 4250428 - RNA, 59 nt, Shigella flexneri 2a str. 301
agauccacgcugaaguaccgcugucugaaauguucggauacgcaacucagcugcguucu

SEQ ID NO: 4250429 - RNA, 56 nt, Shigella flexneri 2a str. 301; identical to SEQ ID NO: 4249454

SEQ ID NO: 4250430 - RNA, 68 nt, Shigella flexneri 2a str. 301; identical to SEQ ID NO: 4228054

SEQ ID NO: 4250431 - RNA, 61 nt, Shigella flexneri 2a str. 301; identical to SEQ ID NO: 4228551

SEQ ID NO: 4250432 - RNA, 63 nt, Shigella flexneri 2a str. 301; identical to SEQ ID NO: 4248920

SEQ ID NO: 4250433 - RNA, 98 nt, Shigella flexneri 2a str. 301
uccucuucuuuacgcugaacagugaggauuucgauaauaucguguugguuuugcagaucggagagguauuucggcaguucuuuuugugaggagacgga

SEQ ID NO: 4250434 - RNA, 69 nt, Shigella flexneri 2a str. 301; identical to SEQ ID NO: 4227301

SEQ ID NO: 4250435 - RNA, 87 nt, Shigella flexneri 2a str. 301
cugguacucuccucgacgcugcucggucaguuguuguuuuuugaaauuacgggcggcugcuccugggcguugaucaguuauuaccag

SEQ ID NO: 4250436 - RNA, 56 nt, Shigella flexneri 2a str. 301; identical to SEQ ID NO: 4249354

SEQ ID NO: 4250437 - RNA, 82 nt, Shigella flexneri 2a str. 301
gcgugccugguuuuaucgacguucccggucaugaaaaguuucuuuccaacaugcuggcgggcguuggugguaucgaucacgc

SEQ ID NO: 4250438 - RNA, 56 nt, Shigella flexneri 2a str. 301
augcuggcgauguacuacgucaucacucccuuugguggcuggaucaacggcgguau

SEQ ID NO: 4250439 - RNA, 69 nt, Shigella flexneri 2a str. 301; identical to SEQ ID NO: 4249548

SEQ ID NO: 4250440 - RNA, 69 nt, Shigella flexneri 2a str. 301
gauaugaguaaagguacgguuucugcggcgaugggaaugcugcaaaugcugaucuuuaccgucgguauu

SEQ ID NO: 4250441 - RNA, 97 nt, Shigella flexneri 2a str. 301
gcuguaggagcgaacgucugguucagcagauuuggcgcaccuggcagauugugguucggguucguagucgcucugaacuugcguuucugcuuacagc

SEQ ID NO: 4250442 - RNA, 77 nt, Shigella flexneri 2a str. 301; identical to SEQ ID NO: 4249532

SEQ ID NO: 4250443 - RNA, 66 nt, Shigella flexneri 2a str. 301; identical to SEQ ID NO: 4248915

SEQ ID NO: 4250444 - RNA, 84 nt, Shigella flexneri 2a str. 301; identical to SEQ ID NO: 4249654

SEQ ID NO: 4250445 - RNA, 58 nt, Shigella flexneri 2a str. 301
ugcaaauaguaaugagaacgacuaucaauucgacgucguuuugauauuauuaugcgca

SEQ ID NO: 4250446 - RNA, 82 nt, Shigella flexneri 2a str. 301; identical to SEQ ID NO: 4249649

SEQ ID NO: 4250447 - RNA, 62 nt, Shigella flexneri 2a str. 301; identical to SEQ ID NO: 4248753

SEQ ID NO: 4250448 - RNA, 81 nt, Shigella flexneri 2a str. 301
ucgccgcauggcggagaugauucaggcagacugggcgaaagugggcgugcaggccaaaaucgucaccuacgaaugggguga

SEQ ID NO: 4250449 - RNA, 81 nt, Shigella flexneri 2a str. 301
cgugggcguuauccauaaaagccacaaucgguaaugacuccaacuuacugauaguguuuuauguucagauaaugcccgaug

SEQ ID NO: 4250450 - RNA, 64 nt, Shigella flexneri 2a str. 301
gggugauuaugugcaaggaucagcgccgaggcguuuauuuuuaucgcuucgcggauaauuuccc

SEQ ID NO: 4250451 - RNA, 63 nt, Shigella flexneri 2a str. 301
gugaauaaucagcuccgaaccuuugcucaacuggcacuggauaaauccgagcuggucauucgc

SEQ ID NO: 4250452 - RNA, 75 nt, Shigella flexneri 2a str. 301; identical to SEQ ID NO: 4249081

SEQ ID NO: 4250453 - RNA, 69 nt, Shigella flexneri 2a str. 301; identical to SEQ ID NO: 4249362

SEQ ID NO: 4250454 - RNA, 74 nt, Shigella flexneri 2a str. 301; identical to SEQ ID NO: 4249129

SEQ ID NO: 4250455 - RNA, 108 nt, Shigella flexneri 2a str. 301
ggcgugguuagugaaacgcuuugggacacguaaugucauccuggucacgauguccugcgcauugaucgggaugaugauauuaagucuggcacucuggcugacaucgcc

SEQ ID NO: 4250456 - RNA, 82 nt, Shigella flexneri 2a str. 301; identical to SEQ ID NO: 4248898

SEQ ID NO: 4250457 - RNA, 81 nt, Shigella flexneri 2a str. 301; identical to SEQ ID NO: 4249347

SEQ ID NO: 4250458 - RNA, 58 nt, Shigella flexneri 2a str. 301
uucaacguaaaguacguagcagagaucacauugauaucucuguuauaucuugcuugaa

SEQ ID NO: 4250459 - RNA, 73 nt, Shigella flexneri 2a str. 301; identical to SEQ ID NO: 4248877

SEQ ID NO: 4250460 - RNA, 63 nt, Shigella flexneri 2a str. 301; identical to SEQ ID NO: 4248930

SEQ ID NO: 4250461 - RNA, 114 nt, Shigella flexneri 2a str. 301
uaucgauaacuaaagccuuacugguauaagcaggcauggaggucacgguugaagccagaucaggcaucucagcaaugucuucguccuucguaucaauaguugcagucaucgaua

SEQ ID NO: 4250462 - RNA, 81 nt, Shigella flexneri 2a str. 301; identical to SEQ ID NO: 4249373

SEQ ID NO: 4250463 - RNA, 79 nt, Shigella flexneri 2a str. 301
gguaucugguuuaugacaguccagacaggcggcauccggguuacgcugcuggguaacuucguagcgaucaccagaugcc

SEQ ID NO: 4250464 - RNA, 60 nt, Shigella flexneri 2a str. 301; identical to SEQ ID NO: 4248960

SEQ ID NO: 4250465 - RNA, 58 nt, Shigella flexneri 2a str. 301; identical to SEQ ID NO: 4249370

SEQ ID NO: 4250466 - RNA, 71 nt, Shigella flexneri 2a str. 301; identical to SEQ ID NO: 4249297

SEQ ID NO: 4250467 - RNA, 58 nt, Shigella flexneri 2a str. 301; identical to SEQ ID NO: 4227721

SEQ ID NO: 4250468 - RNA, 77 nt, Shigella flexneri 2a str. 301
ccagaucaucggugcugacggguugauuuuccaggaucugaacgaucugaucgacgccguucgcgcugaaaauccgg

SEQ ID NO: 4250469 - RNA, 70 nt, Shigella flexneri 2a str. 301
gugccggaugcgcuucgcuuauccggccuacacgcgaugccaggucagauaagcgaaacgcauccggcau

SEQ ID NO: 4250470 - RNA, 74 nt, Shigella flexneri 2a str. 301; identical to SEQ ID NO: 4248980

SEQ ID NO: 4250471 - RNA, 74 nt, Shigella flexneri 2a str. 301; identical to SEQ ID NO: 4248946

SEQ ID NO: 4250472 - RNA, 68 nt, Shigella flexneri 2a str. 301
ucaauagggucaagguuuuucaucccgccaagaucuucugccaccuguuugagcauugaccuuguuga

SEQ ID NO: 4250473 - RNA, 59 nt, Shigella flexneri 2a str. 301; identical to SEQ ID NO: 4249042

SEQ ID NO: 4250474 - RNA, 56 nt, Shigella flexneri 2a str. 301; identical to SEQ ID NO: 4249641

SEQ ID NO: 4250475 - RNA, 114 nt, Shigella flexneri 2a str. 301
gcaaaauugccugaugcgcugcgcuuaucaggccuacagcauauaaugcaacauuuugaauuagcacgauuuuguaggccggauaaggcguuuacgccgcauccggcauuuugu

SEQ ID NO: 4250476 - RNA, 62 nt, Shigella flexneri 2a str. 301
ggaaggggaacucuggugcgcuaaugccuuuuaucuuuuugaugcgcagaaagucgccuucu

SEQ ID NO: 4250477 - RNA, 59 nt, Shigella flexneri 2a str. 301
gcgggggcgcuuguggucgucguuccacagcuuaguggugaugaacaguucuucucugu

SEQ ID NO: 4250478 - RNA, 56 nt, Shigella flexneri 2a str. 301
cuguugcaguacuuucgugguguuaaccaugguggcaccggaagguaacugcgcgg

SEQ ID NO: 4250479 - RNA, 62 nt, Shigella flexneri 2a str. 301
gagcguuuucaccguccgguuaucgccuuugcgccagcaggugacgguacgcugaaagguuc

SEQ ID NO: 4250480 - RNA, 60 nt, Shigella flexneri 2a str. 301; identical to SEQ ID NO: 4249550

SEQ ID NO: 4250481 - RNA, 71 nt, Shigella flexneri 2a str. 301; identical to SEQ ID NO: 4249464

SEQ ID NO: 4250482 - RNA, 58 nt, Shigella flexneri 2a str. 301; identical to SEQ ID NO: 4249538

SEQ ID NO: 4250483 - RNA, 59 nt, Shigella flexneri 2a str. 301
augaaauccgaaugaaauaacgccgcgauggcgauaaauuaaucucauucggaugucgu

SEQ ID NO: 4250484 - RNA, 73 nt, Shigella flexneri 2a str. 301; identical to SEQ ID NO: 4228515

SEQ ID NO: 4250485 - RNA, 66 nt, Shigella flexneri 2a str. 301; identical to SEQ ID NO: 4249441

SEQ ID NO: 4250486 - RNA, 98 nt, Shigella flexneri 2a str. 301
gcacuggagauguuguuaccuguuggucuguaugugucaguuggcgugacgcuagggcagauguauaccgacucggaaauuaccgcuaucucugcggc

SEQ ID NO: 4250487 - RNA, 117 nt, Shigella flexneri 2a str. 301; identical to SEQ ID NO: 4249195

SEQ ID NO: 4250488 - RNA, 59 nt, Shigella flexneri 2a str. 301
ucgguaccaaauuccagaaaagagacgcugaaaagcgucucuuuucguuuugguccugg

SEQ ID NO: 4250489 - RNA, 108 nt, Shigella flexneri 2a str. 301; identical to SEQ ID NO: 4249623

SEQ ID NO: 4250490 - RNA, 56 nt, Shigella flexneri 2a str. 301; identical to SEQ ID NO: 4249599

SEQ ID NO: 4250491 - RNA, 60 nt, Shigella flexneri 2a str. 301
gcuggagccuguugggugacacgauacuggccucgccuuuacgugcccgcgggcuucggu

SEQ ID NO: 4250492 - RNA, 88 nt, Shigella flexneri 2a str. 301; identical to SEQ ID NO: 4249004

SEQ ID NO: 4250493 - RNA, 55 nt, Shigella flexneri 2a str. 301; identical to SEQ ID NO: 4249685

SEQ ID NO: 4250494 - RNA, 55 nt, Shigella flexneri 2a str. 301; identical to SEQ ID NO: 4249038

SEQ ID NO: 4250495 - RNA, 75 nt, Shigella flexneri 2a str. 301
ucuggugagauaucagaugauuaaaauggcggaacaucugaaagguuacugcccgaaucaacugaguuucucaga

SEQ ID NO: 4250496 - RNA, 89 nt, Shigella flexneri 2a str. 301; identical to SEQ ID NO: 4227126

SEQ ID NO: 4250497 - RNA, 118 nt, Shigella flexneri 2a str. 301; identical to SEQ ID NO: 4249361

SEQ ID NO: 4250498 - RNA, 68 nt, Shigella flexneri 2a str. 301; identical to SEQ ID NO: 4249317

SEQ ID NO: 4250499 - RNA, 79 nt, Shigella flexneri 2a str. 301
uauccugagccggaacuuugcugcaaugaaggccaacgaaaaaugggggaguauguuauagaguacuugcuacagggua

SEQ ID NO: 4250500 - RNA, 100 nt, Shigella flexneri 2a str. 301; identical to SEQ ID NO: 4249024

SEQ ID NO: 4250501 - RNA, 98 nt, Shigella flexneri 2a str. 301; identical to SEQ ID NO: 4248958

SEQ ID NO: 4250502 - RNA, 98 nt, Shigella flexneri 2a str. 301; identical to SEQ ID NO: 4248864

SEQ ID NO: 4250503 - RNA, 66 nt, Shigella flexneri 2a str. 301
agcgcacuuugucaauaaucugaaaccccggccaugcgccgggguuucuuuuugacuaauuguucu

SEQ ID NO: 4250504 - RNA, 68 nt, Shigella flexneri 2a str. 301
cgucugguuugaguuuugagcaggcgaugcaaacucgugucuuccagccacucaaacucaaccauacg

SEQ ID NO: 4250505 - RNA, 64 nt, Shigella flexneri 2a str. 301
ggcggcuuucaacgagaauagguucgaaauuuucaccaaucaccaguuccguagauccgccgcc

SEQ ID NO: 4250506 - RNA, 72 nt, Shigella flexneri 2a str. 301; identical to SEQ ID NO: 4248893

SEQ ID NO: 4250507 - RNA, 83 nt, Shigella flexneri 2a str. 301
gccauaccagaccagaaugcaguagucgcagcggaagugaugguaauaccacguuccugcuccugcuccauccaguccauggu

SEQ ID NO: 4250508 - RNA, 106 nt, Shigella flexneri 2a str. 301
guguuguugcacggugagccgcuauggcgcgcuuuuuauacugcuauugccagauauaaacacgcgccguauucggcgaacgaccuauaaaaacggcaaaaaacac

SEQ ID NO: 4250509 - RNA, 85 nt, Shigella flexneri 2a str. 301; identical to SEQ ID NO: 4249684

SEQ ID NO: 4250510 - RNA, 73 nt, Shigella flexneri 2a str. 301; identical to SEQ ID NO: 4249118

SEQ ID NO: 4250511 - RNA, 59 nt, Shigella flexneri 2a str. 301; identical to SEQ ID NO: 4249119

SEQ ID NO: 4250512 - RNA, 70 nt, Shigella flexneri 2a str. 301
gaaauucuucgcugaacgcguagauaaagaugccguuucacgucuggaacgcuucauugaagccgauuuc

SEQ ID NO: 4250513 - RNA, 71 nt, Shigella flexneri 2a str. 301; identical to SEQ ID NO: 4249530

SEQ ID NO: 4250514 - RNA, 61 nt, Shigella flexneri 2a str. 301; identical to SEQ ID NO: 4248865

SEQ ID NO: 4250515 - RNA, 64 nt, Shigella flexneri 2a str. 301
cgggcacacgaaaggagauauuacgcagugcaaaagugguaucggaaugauucguguauuccug

SEQ ID NO: 4250516 - RNA, 111 nt, Shigella flexneri 2a str. 301
ugcgguuacgacuggugaaauuagcccgguagguggaugcugagugcugguuaggugucugcaucccuacucgggcaauaaaauucucauaaccaucagcuguggccugca

SEQ ID NO: 4250517 - RNA, 89 nt, Shigella flexneri 2a str. 301
ugaugagcugaugggcgugcugccagugaccaaagaacaguuggguaaaaaaacgcuggcgcaaaugcccauuaauccacuguuuauua

SEQ ID NO: 4250518 - RNA, 77 nt, Shigella flexneri 2a str. 301
accagcaacagaucagagacgccaauuuguugugcugcgguggcuugcagcgcggcgaacagggcguuagaugaggu

SEQ ID NO: 4250519 - RNA, 58 nt, Shigella flexneri 2a str. 301
aucacuuuacgcuuaguggcaagaucuucaggguuaaaccagcugacgccaaagugau

SEQ ID NO: 4250520 - RNA, 81 nt, Shigella flexneri 2a str. 301
guagaaagauagucagccaguugauaaaccggaauuuuuucuucugcuggcguaucaauggcuggcuuauugugauucugc

SEQ ID NO: 4250521 - RNA, 61 nt, Shigella flexneri 2a str. 301
aggauuuuuucaaaucccacuacgaaggccgaagucuucacaguauauuugaaaaaggacu

SEQ ID NO: 4250522 - RNA, 62 nt, Shigella flexneri 2a str. 301; identical to SEQ ID NO: 4249655

SEQ ID NO: 4250523 - RNA, 67 nt, Shigella flexneri 2a str. 301
gccguggaaaucggugauugauaacguuggguuaggccuuaaaggucaguggcgcgaugccgcgcgu

SEQ ID NO: 4250524 - RNA, 64 nt, Shigella flexneri 2a str. 301; identical to SEQ ID NO: 4248813

SEQ ID NO: 4250525 - RNA, 76 nt, Shigella flexneri 2a str. 301; identical to SEQ ID NO: 4227969

SEQ ID NO: 4250526 - RNA, 60 nt, Shigella flexneri 2a str. 301; identical to SEQ ID NO: 4249204

SEQ ID NO: 4250527 - RNA, 77 nt, Shigella flexneri 2a str. 301
caugucacgguuuccuguaaagugguguuauaaaaugaacuacuaauagacccacauacauucagggaauuguuaug

SEQ ID NO: 4250528 - RNA, 77 nt, Shigella flexneri 2a str. 301
gcgaucgcuuuagccguagaggcuguuucugcaccugcagcaaucacgucagcaauagcuucuggguuacggucagc

SEQ ID NO: 4250529 - RNA, 77 nt, Shigella flexneri 2a str. 301
auuuuucgcccguagcuucuucgcuuggcuuuccaguagcagguaacagaucagcgccagcagcagcgggauaaagu

SEQ ID NO: 4250530 - RNA, 62 nt, Shigella flexneri 2a str. 301
uccgaugguugugccguuucgcuccgcuccgggcggcgcggaauaaacgauacaacccagga

SEQ ID NO: 4250531 - RNA, 56 nt, Shigella flexneri 2a str. 301; identical to SEQ ID NO: 4249663

SEQ ID NO: 4250532 - RNA, 63 nt, Shigella flexneri 2a str. 301; identical to SEQ ID NO: 4249353

SEQ ID NO: 4250533 - RNA, 87 nt, Shigella flexneri 2a str. 301; identical to SEQ ID NO: 4248399

SEQ ID NO: 4250534 - RNA, 55 nt, Shigella flexneri 2a str. 301; identical to SEQ ID NO: 4249027

SEQ ID NO: 4250535 - RNA, 68 nt, Shigella flexneri 2a str. 301; identical to SEQ ID NO: 4248828

SEQ ID NO: 4250536 - RNA, 72 nt, Shigella flexneri 2a str. 301
aaugccggauacgugguuuuaaaagaucuuaaugguccacugcaauaucuguugaugccaacguaucguauu

SEQ ID NO: 4250537 - RNA, 78 nt, Shigella flexneri 2a str. 301
ccggaagggguuaucggcaugcgaggggcuaugaaaacacaaaaggcuuuccgccugccgauaacgccugagauccgg

SEQ ID NO: 4250538 - RNA, 57 nt, Shigella flexneri 2a str. 301
cgauguuggcggcuauggguuucacgccgucguagaaauccggacgcguuaacaccg

SEQ ID NO: 4250539 - RNA, 75 nt, Shigella flexneri 2a str. 301; identical to SEQ ID NO: 4245755

SEQ ID NO: 4250540 - RNA, 55 nt, Shigella flexneri 2a str. 301
augcuugauuaaaaaggcgcuacucggcauggggaagcgccuuuuuuauaggugu

SEQ ID NO: 4250541 - RNA, 57 nt, Shigella flexneri 2a str. 301; identical to SEQ ID NO: 4249639

SEQ ID NO: 4250542 - RNA, 62 nt, Shigella flexneri 2a str. 301; identical to SEQ ID NO: 4249578

SEQ ID NO: 4250543 - RNA, 79 nt, Shigella flexneri 2a str. 301
ggauaccagaacugaauguauuuacccacggcagucagcucugccauggcaacuaaaacguacaguacccaguaguucc

SEQ ID NO: 4250544 - RNA, 130 nt, Shigella flexneri 2a str. 301
cacguaaucaccugcugauuaucguccugcuguuauugcuguuaacgcuggugcuggcgggccugguacggauggcugcgcggguguuaauggcgaaaccgccgcaggccguuaaccggggugaucucgg

SEQ ID NO: 4250545 - RNA, 65 nt, Shigella flexneri 2a str. 301; identical to SEQ ID NO: 4249446

SEQ ID NO: 4250546 - RNA, 122 nt, Shigella flexneri 2a str. 301
cggcuaugcgaaacgcgaugaaacacugacucauccgcgcuguguguggaaccugcugaaagcgcacguuucccgcuacacgccggacguuguugaaaacaucugugguacgccaaaagccg

SEQ ID NO: 4250547 - RNA, 57 nt, Shigella flexneri 2a str. 301; identical to SEQ ID NO: 4227166

SEQ ID NO: 4250548 - RNA, 85 nt, Shigella flexneri 2a str. 301; identical to SEQ ID NO: 4249404

SEQ ID NO: 4250549 - RNA, 73 nt, Shigella flexneri 2a str. 301; identical to SEQ ID NO: 4227180

SEQ ID NO: 4250550 - RNA, 84 nt, Shigella flexneri 2a str. 301
aguugguacgucguugacaaugacgcuguggggacgacgcgaaucguuacaccauagucaguugacagcaaccaucgaucaauu

SEQ ID NO: 4250551 - RNA, 98 nt, Shigella flexneri 2a str. 301; identical to SEQ ID NO: 4249202

SEQ ID NO: 4250552 - RNA, 114 nt, Shigella flexneri 2a str. 301
cgcugcauugcuugcgccacucagcaauaaagaguucaugacgggcagcgguaucauuuuccaguuugcugacuaucggaacuuuuuugcugcccugcugaauaauaugcagcg

SEQ ID NO: 4250553 - RNA, 55 nt, Shigella flexneri 2a str. 301; identical to SEQ ID NO: 4249604

SEQ ID NO: 4250554 - RNA, 65 nt, Shigella flexneri 2a str. 301; identical to SEQ ID NO: 4228215

SEQ ID NO: 4250555 - RNA, 66 nt, Shigella flexneri 2a str. 301
gugauaaagaaaugggugagaugacaacgaugugaugaacaaucguugucagaccuauuagcgcac

SEQ ID NO: 4250556 - RNA, 97 nt, Shigella flexneri 2a str. 301
ccaucaccucuggcgaugcagcgaugugcaaauacuucugcgccaaugcggcauuugaagugguggauagcgcaaugcaggugcugggcggugucgg

SEQ ID NO: 4250557 - RNA, 70 nt, Shigella flexneri 2a str. 301
cguaugggcgcuuacgcuaucgaucugcugcuggcagguuacggcggucguuguguagguauccagaacg

SEQ ID NO: 4250558 - RNA, 77 nt, Shigella flexneri 2a str. 301
agauuuuccguuccgcugccauuuuucauuuucauugauaucuaaggcaacaaaaaauggauagccgaaucaugucu

SEQ ID NO: 4250559 - RNA, 70 nt, Shigella flexneri 2a str. 301
acgccuuauccggccuacaaaagcacgcaaauucaauauauugcagagauugcguaggccugauaagcgu

SEQ ID NO: 4250560 - RNA, 65 nt, Shigella flexneri 2a str. 301; identical to SEQ ID NO: 4249076

SEQ ID NO: 4250561 - RNA, 74 nt, Shigella flexneri 2a str. 301
gcagcuguuuauuggcguugauuccgcaccggcgcauauugccgcugcaguuaauacgccgcugauaucgcugu

SEQ ID NO: 4250562 - RNA, 110 nt, Shigella flexneri 2a str. 301; identical to SEQ ID NO: 4249279

SEQ ID NO: 4250563 - RNA, 58 nt, Shigella flexneri 2a str. 301
cgcuaucgccugcgaaucuaaaucagguuuaaugguuugcccuucgcagguggucacg

SEQ ID NO: 4250564 - RNA, 84 nt, Shigella flexneri 2a str. 301; identical to SEQ ID NO: 4248819

SEQ ID NO: 4250565 - RNA, 78 nt, Shigella flexneri 2a str. 301; identical to SEQ ID NO: 4249385

SEQ ID NO: 4250566 - RNA, 75 nt, Shigella flexneri 2a str. 301
ggcguaaccggcacacugcgcgccucauuugcgccauauaauacaaagagugauguggaugcgcuggugaaugcc

SEQ ID NO: 4250567 - RNA, 130 nt, Shigella flexneri 2a str. 301
caaauacaguguugaugugcgcccgaguugcugaguaacggugagcuguaauuucccgcguuuguuauaagcgagguuguaauagucggugaauuucggcuuaaccugaauaacuccauccuguguuucg

SEQ ID NO: 4250568 - RNA, 88 nt, Shigella flexneri 2a str. 301
ucgauaccgaaugguguuccgacuggaaaugggaucguguucugccccaucuuucugauuuaaccggacgcaccauucuggaugucgg

SEQ ID NO: 4250569 - RNA, 77 nt, Shigella flexneri 2a str. 301
cuaaacucgaaugggcgauaggugcgguagugcuggugaucaucagccugcuugcgacucucgaaccuuuuugaugg

SEQ ID NO: 4250570 - RNA, 58 nt, Shigella flexneri 2a str. 301
cacgccguggcgugcagcaugguuuucauuacgggccaguugcagacguacacgggug

SEQ ID NO: 4250571 - RNA, 58 nt, Shigella flexneri 2a str. 301
ucuucccgcauagacguuguuguagguggugcuucaacgcguucuuuaguggugaaga

SEQ ID NO: 4250572 - RNA, 61 nt, Shigella flexneri 2a str. 301; identical to SEQ ID NO: 4228511

SEQ ID NO: 4250573 - RNA, 55 nt, Shigella flexneri 2a str. 301; identical to SEQ ID NO: 4249325

SEQ ID NO: 4250574 - RNA, 64 nt, Shigella flexneri 2a str. 301
cggaauuggauggucgcccauggaaaugcagacguucuucauuuccgcgaacacuucgaagcug

SEQ ID NO: 4250575 - RNA, 69 nt, Shigella flexneri 2a str. 301; identical to SEQ ID NO: 4249444

SEQ ID NO: 4250576 - RNA, 55 nt, Shigella flexneri 2a str. 301; identical to SEQ ID NO: 4228214

SEQ ID NO: 4250577 - RNA, 68 nt, Shigella flexneri 2a str. 301
ggugacggcuauaucuacugcgugauugaacaucaaagcucugcagaaaagaauauggcuuuucggcc

SEQ ID NO: 4250578 - RNA, 77 nt, Shigella flexneri 2a str. 301; identical to SEQ ID NO: 4248844

SEQ ID NO: 4250579 - RNA, 56 nt, Shigella flexneri 2a str. 301; identical to SEQ ID NO: 4249484

SEQ ID NO: 4250580 - RNA, 55 nt, Shigella flexneri 2a str. 301; identical to SEQ ID NO: 4227894

SEQ ID NO: 4250581 - RNA, 115 nt, Shigella flexneri 2a str. 301
gaaugcguuuguucgcauguacggcgcagaugccguagaagccgccagugcggcaaugagcggcgaagcggcguuuuacggccugcaaccgguagauagcgaucugcacgcguuu

SEQ ID NO: 4250582 - RNA, 67 nt, Shigella flexneri 2a str. 301; identical to SEQ ID NO: 4249485

SEQ ID NO: 4250583 - RNA, 102 nt, Shigella flexneri 2a str. 301
uccgcuggaaguugaguacgugcguucggaaaugcagguggaauuuaccaauaucaccaccucgccgaacgacauugugguuaacacgccguuccaugugga

SEQ ID NO: 4250584 - RNA, 78 nt, Shigella flexneri 2a str. 301; identical to SEQ ID NO: 4249592

SEQ ID NO: 4250585 - RNA, 64 nt, Shigella flexneri 2a str. 301; identical to SEQ ID NO: 4249713

SEQ ID NO: 4250586 - RNA, 56 nt, Shigella flexneri 2a str. 301; identical to SEQ ID NO: 4248804

SEQ ID NO: 4250587 - RNA, 80 nt, Shigella flexneri 2a str. 301; identical to SEQ ID NO: 4248890

SEQ ID NO: 4250588 - RNA, 69 nt, Shigella flexneri 2a str. 301
gccagcgagucuucaccaacggccagugagucuucugccguugaguuggcgugaaaguacuugguuggc

SEQ ID NO: 4250589 - RNA, 55 nt, Shigella flexneri 2a str. 301
acuggaaacuguuaccaucgcgucuaaagcuggcgacgaagguaaacuguucggu

SEQ ID NO: 4250590 - RNA, 71 nt, Shigella flexneri 2a str. 301; identical to SEQ ID NO: 4249109

SEQ ID NO: 4250591 - RNA, 86 nt, Shigella flexneri 2a str. 301; identical to SEQ ID NO: 4249045

SEQ ID NO: 4250592 - RNA, 56 nt, Shigella flexneri 2a str. 301; identical to SEQ ID NO: 4249016

SEQ ID NO: 4250593 - RNA, 58 nt, Shigella flexneri 2a str. 301; identical to SEQ ID NO: 4249329

SEQ ID NO: 4250594 - RNA, 61 nt, Shigella flexneri 2a str. 301; identical to SEQ ID NO: 4249500

SEQ ID NO: 4250595 - RNA, 66 nt, Shigella flexneri 2a str. 301; identical to SEQ ID NO: 4249424

SEQ ID NO: 4250596 - RNA, 58 nt, Shigella flexneri 2a str. 301
cauggugucaauauccugcggcugacgcggcucaugaacgcugauauuggcgcgcaug

SEQ ID NO: 4250597 - RNA, 90 nt, Shigella flexneri 2a str. 301
uuggcgcagugaucgcugacaggagcgcuccagccccuucgauggcugaaucgaacagccgagcgacuucugcacgguaaacguguucag

SEQ ID NO: 4250598 - RNA, 69 nt, Shigella flexneri 2a str. 301; identical to SEQ ID NO: 4249139

SEQ ID NO: 4250599 - RNA, 80 nt, Shigella flexneri 2a str. 301; identical to SEQ ID NO: 4248836

SEQ ID NO: 4250600 - RNA, 85 nt, Shigella flexneri 2a str. 301
uucaauggcgcaggugucgagcagauccagcgccuggucgguuaauuuacgcagcguggccugcuuuacgccuuccguuguugga

SEQ ID NO: 4250601 - RNA, 63 nt, Shigella flexneri 2a str. 301; identical to SEQ ID NO: 4249508

SEQ ID NO: 4250602 - RNA, 83 nt, Shigella flexneri 2a str. 301; identical to SEQ ID NO: 4227256

SEQ ID NO: 4250603 - RNA, 55 nt, Shigella flexneri 2a str. 301; identical to SEQ ID NO: 4249448

SEQ ID NO: 4250604 - RNA, 65 nt, Shigella flexneri 2a str. 301
gaccuucaauaauaugcaaugcagcuucccgcccgauaaugucauguggaagcugaauugugguc

SEQ ID NO: 4250605 - RNA, 57 nt, Shigella flexneri 2a str. 301
accugauuaaaucugcccguguugguuauacaaaaauggugcuuggugugaucgggu

SEQ ID NO: 4250606 - RNA, 88 nt, Shigella flexneri 2a str. 301
augagcgccaacaaaacgugccggucuuccuguugggcgaucgggaaaaagcccucgccgcaauggaccgggaucugcuggagcuugu

SEQ ID NO: 4250607 - RNA, 67 nt, Shigella flexneri 2a str. 301; identical to SEQ ID NO: 4249339

SEQ ID NO: 4250608 - RNA, 59 nt, Shigella flexneri 2a str. 301; identical to SEQ ID NO: 4249601

SEQ ID NO: 4250609 - RNA, 62 nt, Shigella flexneri 2a str. 301; identical to SEQ ID NO: 4249431

SEQ ID NO: 4250610 - RNA, 57 nt, Shigella flexneri 2a str. 301; identical to SEQ ID NO: 4227958

SEQ ID NO: 4250611 - RNA, 84 nt, Shigella flexneri 2a str. 301
gcugaugcgcagguuauagaacuggugcgucagcagcugggguuggaucagccgcuguaucaccaguucuggcacuauaucagc

SEQ ID NO: 4250612 - RNA, 55 nt, Shigella flexneri 2a str. 301; identical to SEQ ID NO: 4227551

SEQ ID NO: 4250613 - RNA, 129 nt, Shigella flexneri 2a str. 301
ccguagaucguauggcgugaucugauagacguaauaguugagccaguugguaaacagcaaauuaccgugacuacgccagcucgcucgcgguuuguuuugcggaucguugugcgggaaauaguuauacgg

SEQ ID NO: 4250614 - RNA, 70 nt, Shigella flexneri 2a str. 301; identical to SEQ ID NO: 4249411

SEQ ID NO: 4250615 - RNA, 55 nt, Shigella flexneri 2a str. 301; identical to SEQ ID NO: 4249179

SEQ ID NO: 4250616 - RNA, 112 nt, Shigella flexneri 2a str. 301
gcuggugauuggugcaggcggcguguucaaacaggugcugguugacucuggcguagguccggcacugggcgaagcguuaaccggcaugggccugccgauugcuaucaccugc

SEQ ID NO: 4250617 - RNA, 90 nt, Shigella flexneri 2a str. 301; identical to SEQ ID NO: 4248823

SEQ ID NO: 4250618 - RNA, 129 nt, Shigella flexneri 2a str. 301; identical to SEQ ID NO: 4249044

SEQ ID NO: 4250619 - RNA, 68 nt, Shigella flexneri 2a str. 301; identical to SEQ ID NO: 4248880

SEQ ID NO: 4250620 - RNA, 88 nt, Shigella flexneri 2a str. 301
ugaaccaugaaaucaaaaaucaaaucgcuacuggucgcugguuauaaccacggcugguuaaguauuucguuugucgauuucugguuua

SEQ ID NO: 4250621 - RNA, 71 nt, Shigella flexneri 2a str. 301
gacaaaaccugcguuauucuuucauguuucccauugcaucaugggggaaaucacggaagaaugcgcacguc

SEQ ID NO: 4250622 - RNA, 80 nt, Shigella flexneri 2a str. 301; identical to SEQ ID NO: 4249153

SEQ ID NO: 4250623 - RNA, 75 nt, Shigella flexneri 2a str. 301; identical to SEQ ID NO: 4228306

SEQ ID NO: 4250624 - RNA, 68 nt, Shigella flexneri 2a str. 301
uauuuucgccggugguuaugcggcagguuacuacagcuaccugugggcugacguacuggcggcagaug

SEQ ID NO: 4250625 - RNA, 99 nt, Shigella flexneri 2a str. 301
ggcgcuaaugggcguacaguuugcgcugaugugggcaguacuggcguuuuugcucaacuacgugcccaauaucggcgcgguaauuuccgccguaccgcc

SEQ ID NO: 4250626 - RNA, 129 nt, Shigella flexneri 2a str. 301; identical to SEQ ID NO: 4249607

SEQ ID NO: 4250627 - RNA, 56 nt, Shigella flexneri 2a str. 301
auggcggaaguccgaccuucagccguauugccgcuggcggcggauuuaucugccau

SEQ ID NO: 4250628 - RNA, 55 nt, Shigella flexneri 2a str. 301; identical to SEQ ID NO: 4248953

SEQ ID NO: 4250629 - RNA, 76 nt, Shigella flexneri 2a str. 301
gaauuuaugaauaaauugcaugugauucucggauuauugcaucugaagaguuauaagcaguuggaagauuacauuc

SEQ ID NO: 4250630 - RNA, 57 nt, Shigella flexneri 2a str. 301; identical to SEQ ID NO: 4249268

SEQ ID NO: 4250631 - RNA, 75 nt, Shigella flexneri 2a str. 301; identical to SEQ ID NO: 4249602

SEQ ID NO: 4250632 - RNA, 56 nt, Shigella flexneri 2a str. 301; identical to SEQ ID NO: 4249489

SEQ ID NO: 4250633 - RNA, 55 nt, Shigella flexneri 2a str. 301
guugcgucugcuccugaaugacaggcuuuaugucaucaggaacaaccggcgcgac

SEQ ID NO: 4250634 - RNA, 59 nt, Shigella flexneri 2a str. 301
gcucgauaaacccuuuuucauccggcgucgaggccauugagaacggacguuugucgcgc

SEQ ID NO: 4250635 - RNA, 64 nt, Shigella flexneri 2a str. 301
cauagagaauucggguuuccauacugugacaguaaacacacuggaugccacuaauacugcugug

SEQ ID NO: 4250636 - RNA, 58 nt, Shigella flexneri 2a str. 301; identical to SEQ ID NO: 4249288

SEQ ID NO: 4250637 - RNA, 62 nt, Shigella flexneri 2a str. 301; identical to SEQ ID NO: 4249006

SEQ ID NO: 4250638 - RNA, 55 nt, Shigella flexneri 2a str. 301
cagcgaaaugcuguugcagcgcuuacaacacugggcguuugaacgugguucgcug

SEQ ID NO: 4250639 - RNA, 60 nt, Shigella flexneri 2a str. 301; identical to SEQ ID NO: 4227107

SEQ ID NO: 4250640 - RNA, 59 nt, Shigella flexneri 2a str. 301; identical to SEQ ID NO: 4249012

SEQ ID NO: 4250641 - RNA, 129 nt, Shigella flexneri 2a str. 301; identical to SEQ ID NO: 4249600

SEQ ID NO: 4250642 - RNA, 74 nt, Shigella flexneri 2a str. 301; identical to SEQ ID NO: 4249593

SEQ ID NO: 4250643 - RNA, 75 nt, Shigella flexneri 2a str. 301
uuuguuugucggacguaguucggauaaggcguucacgccgcauccgacaaaacauccggcacaccagacagcaaa

SEQ ID NO: 4250644 - RNA, 79 nt, Shigella flexneri 2a str. 301; identical to SEQ ID NO: 4248775

SEQ ID NO: 4250645 - RNA, 67 nt, Shigella flexneri 2a str. 301
gauccugacguugaugucgcuugccgggcguaauacgucggcgcgaaccacaucaaugcuggugauu

SEQ ID NO: 4250646 - RNA, 66 nt, Shigella flexneri 2a str. 301
gcagguucuggucuucuuuacugacgccuggcaguuucgccagcuucgcggagguaucggagaugc

SEQ ID NO: 4250647 - RNA, 78 nt, Shigella flexneri 2a str. 301
uggccguauccuugaaaauggcgaagugaagccgcuggacgugaaaguuggcgacaucguuauuuucaacgauggcua

SEQ ID NO: 4250648 - RNA, 67 nt, Shigella flexneri 2a str. 301; identical to SEQ ID NO: 4249705

SEQ ID NO: 4250649 - RNA, 93 nt, Shigella flexneri 2a str. 301
ggugguuuccugccgcacggcuucaccggacuggugaugaugauggcgauuaucauguucucguucgguggucuggaacugguggggaucacc

SEQ ID NO: 4250650 - RNA, 63 nt, Shigella flexneri 2a str. 301; identical to SEQ ID NO: 4227622

SEQ ID NO: 4250651 - RNA, 116 nt, Shigella flexneri 2a str. 301
uggcauuuucgguaccuuucugcuaaucaguggucuguuauuuaucgcauuuuuguugguuccugcuaugaauaaaucauccugaucggagccugugcugaauuaaacucgggcua

SEQ ID NO: 4250652 - RNA, 76 nt, Shigella flexneri 2a str. 301
gugcugggcgaggauuacauccgcaccgcgcgcgccaaagggcuaacccgcaugcgggugauuaucguccaugcgc

SEQ ID NO: 4250653 - RNA, 59 nt, Shigella flexneri 2a str. 301; identical to SEQ ID NO: 4248784

SEQ ID NO: 4250654 - RNA, 56 nt, Shigella flexneri 2a str. 301; identical to SEQ ID NO: 4249075

SEQ ID NO: 4250655 - RNA, 62 nt, Shigella flexneri 2a str. 301
auggauuacaaaauaaaccacauuaacugauauaaaccgguuugguuuauuugguaauguau

SEQ ID NO: 4250656 - RNA, 69 nt, Shigella flexneri 2a str. 301
aucgacgaacaucaugcgguacguaccgaugccggaauguuugaugugucgcauaugaccaucgucgau

SEQ ID NO: 4250657 - RNA, 100 nt, Staphylococcus aureus subsp. aureus Mu50
uucaauugaagcuggcuuacgccguguuuuagcugaaacaagucaauauauuacuaaugaauuugauuuuacugaagcggaacaagcugguuauguugaa

SEQ ID NO: 4250658 - RNA, 106 nt, Staphylococcus aureus subsp. aureus Mu50
cuucgaccugcagggauuauuuuuugugaaaaugaacguauugaugcuguuucagauggcaacuuuauuuuacgcaauaaaacggugaaaauccuugaaguugaag

SEQ ID NO: 4250659 - RNA, 72 nt, Staphylococcus aureus subsp. aureus Mu50
uuggugguguacguaguauugccaauguugcaacagccguuguaccauuuauggcaauuauuuacauacuga

SEQ ID NO: 4250660 - RNA, 103 nt, Staphylococcus aureus subsp. aureus Mu50
uauuauugcuaugcuuucgauuuuugguaguuuaguucuaggauuaauucaaauuaaugcaggccaacuaaauauuauuuauaugacgaguauaguuuuaaug

SEQ ID NO: 4250661 - RNA, 72 nt, Staphylococcus aureus subsp. aureus Mu50
guuaucugcauuagaacauuuagauaaucagcaacuacacgauuauuuagcucaauuugaugcgguuucugc

SEQ ID NO: 4250662 - RNA, 94 nt, Staphylococcus aureus subsp. aureus Mu50
auaacuagaacuaaaaaauauacacaucuuucaaaggaacauuguuguuucuuacuuugaaagguguguuuuuauauugugaugggauaguuau

SEQ ID NO: 4250663 - RNA, 65 nt, Staphylococcus aureus subsp. aureus Mu50
uaaaaauagguauguagcuuaagguauuucauugagaaugcuuuuaagucacaugccuuuuuuug

SEQ ID NO: 4250664 - RNA, 60 nt, Staphylococcus aureus subsp. aureus Mu50
gaagacaauaaguguaaugaugccuguucuaauacagaaucuuuacuuuuuauugccuuu

SEQ ID NO: 4250665 - RNA, 73 nt, Staphylococcus aureus subsp. aureus Mu50
aaagcacgaguuguaccaugguuuguucuaucuucuuuagaaucagauggucuuacaacuucaauuguguuuu

SEQ ID NO: 4250666 - RNA, 117 nt, Staphylococcus aureus subsp. aureus Mu50
guuuaucaucacaagcaauuuuaaauaucgaauccaaauguuacauuguucgacaugcaguuuggugaucguacaguguguauuugucuuuaaaauguuucgcuuaaugauaaugac

SEQ ID NO: 4250667 - RNA, 84 nt, Staphylococcus aureus subsp. aureus Mu50
cgccgagaguguuaacagauucagcagaauucaaccguguauuagguggagguauugugagcggaucguuaguacuuauuggug

SEQ ID NO: 4250668 - RNA, 63 nt, Staphylococcus aureus subsp. aureus Mu50
uuuuuugguuaaagugauauugcuuaugaaaauaaagcaguaugcgagcgcuugacuaaaaag

SEQ ID NO: 4250669 - RNA, 129 nt, Staphylococcus aureus subsp. aureus Mu50
gcuaaaaaauaaaaaagacauaaucaugauuguucuugaugagcacuccauaaagucagguuaaaaguccaacuuuugagaugcacauuaucauuucaugauuaugucuacuuuuuaauauuuuuaugc

SEQ ID NO: 4250670 - RNA, 82 nt, Staphylococcus aureus subsp. aureus Mu50
gucuucgucuguguuguaaauguuuuaccuuucgcuuuaccugaagcugaaaugguaauaucuuuauuuuguggauauggac

SEQ ID NO: 4250671 - RNA, 58 nt, Staphylococcus aureus subsp. aureus Mu50
ucgucauguguaucuuguggucaaugcgcaacuguauguccauguaaugccaugaugg

SEQ ID NO: 4250672 - RNA, 76 nt, Staphylococcus aureus subsp. aureus Mu50
gcucaacuguaacuguugcuucaaaaaugaaaucuuuaccuuuuucaauuugaguaacacuuacuucugguugugc

SEQ ID NO: 4250673 - RNA, 88 nt, Staphylococcus aureus subsp. aureus Mu50
gaagcuggaacguuuaaucaagcuaugauggaauuaggggcauuaauuuguacaccaaaaaauccauuaugcuuauuuuguccaguuc

SEQ ID NO: 4250674 - RNA, 70 nt, Staphylococcus aureus subsp. aureus Mu50
accuaugguuaugcauaaaaaucccagugauaaaaguauuuaucacugggauuuuuaugcccuuuugggu

SEQ ID NO: 4250675 - RNA, 68 nt, Staphylococcus aureus subsp. aureus Mu50
aacacguugcagcacgugauucuggugcagcuauuacagcuaagcacagaggucguguugaacauguu

SEQ ID NO: 4250676 - RNA, 96 nt, Staphylococcus aureus subsp. aureus Mu50
uuuacauguuaagaaugcugauuuuggugauguuacaggcguuacuuuaggucaugaagguauugguaaagucaucgaaguugcagaagauguaga

SEQ ID NO: 4250677 - RNA, 81 nt, Staphylococcus aureus subsp. aureus Mu50
gcaguugcugagauuacuaaagggaaugugaaagcugaaaauacgggcgaaaaagguucuuuuaguaauuuaggcaauugu

SEQ ID NO: 4250678 - RNA, 92 nt, Staphylococcus aureus subsp. aureus Mu50
uuguugaccgugauguuugggcaagaucucguggcuuaauuucuucugaagaaauggcuaaagaacuuguugaauuaucaaaaaaagaacaa

SEQ ID NO: 4250679 - RNA, 55 nt, Staphylococcus aureus subsp. aureus Mu50
ugggagugggacagaaaugauauuuucgcaaaauuuauuucgucgucccacccca

SEQ ID NO: 4250680 - RNA, 62 nt, Staphylococcus aureus subsp. aureus Mu50
gagcgaugcaauuuuguuauugauggaauaugcauuucacuuaacaucgcuugcauacguuc

SEQ ID NO: 4250681 - RNA, 59 nt, Staphylococcus aureus subsp. aureus Mu50
ggacguauuuuuuaucacauugaaaacuugcagguguucgguggguaaaugauacgucu

SEQ ID NO: 4250682 - RNA, 64 nt, Staphylococcus aureus subsp. aureus Mu50
acugguuaugaaguuauggauuuagauggaaauauuauuggagaaguaacuucaggaacacagu

SEQ ID NO: 4250683 - RNA, 66 nt, Staphylococcus aureus subsp. aureus Mu50
ugaguaccccaacuaaauuaucuaaaugcaguaaugcaaguaaaugaaaguugggguaucgucuca

SEQ ID NO: 4250684 - RNA, 55 nt, Staphylococcus aureus subsp. aureus Mu50
ugagccuggugaaauugaaccaauuccagaggauucagauucugacccagguuca

SEQ ID NO: 4250685 - RNA, 112 nt, Staphylococcus aureus subsp. aureus Mu50
auacuugggaaauaacaguucuauuaagaagcggacagauggaaaagauuuuuacuuuucaucugcccgcuuuuuugauuuugaagugcuguaauaaauuuuacaauaguau

SEQ ID NO: 4250686 - RNA, 105 nt, Staphylococcus aureus subsp. aureus Mu50
uaucuacuauaacaaguacgcuaauuaacuuuguuaauagaguuauucaaggauucguuaauguuguaaacaaaguuagucaagguaugacaaaugcaguaaaua

SEQ ID NO: 4250687 - RNA, 90 nt, Staphylococcus aureus subsp. aureus Mu50
gugauacaauuauuuuugcaucaccaguguauugguauagcauuucagcaccauugaaagcauuuaucgaacauuggucagaaacauuac

SEQ ID NO: 4250688 - RNA, 87 nt, Staphylococcus aureus subsp. aureus Mu50
acguguuuccauuguugauacaaacauuuucaauaauugauucgcuucauauugugaaguuugaaacuguucaacuaugggcaaugu

SEQ ID NO: 4250689 - RNA, 69 nt, Staphylococcus aureus subsp. aureus Mu50
gaugcuaucaaguuuagcaagcgcauucgccguaagguccgcuaacguuuguugaucuugcauaauauu

SEQ ID NO: 4250690 - RNA, 73 nt, Staphylococcus aureus subsp. aureus Mu50
ucgauuucuucuucaguugguucuucaguuggagcaacuacuguuacaacugauucagcugaaucguuuucga

SEQ ID NO: 4250691 - RNA, 83 nt, Staphylococcus aureus subsp. aureus Mu50
cuaggaauuauuauuuaccacuuaaacaagcaaugguugacagguggcuuuuuagguguggauacauuuuuugugaucucugg

SEQ ID NO: 4250692 - RNA, 101 nt, Staphylococcus aureus subsp. aureus Mu50
gaaagcucccaagaguuaauuaaugaagcuguaaacuuauuggugaaaaguaaguaauggauauuguuaauauaguuaucauguuacucauugggguauuc

SEQ ID NO: 4250693 - RNA, 127 nt, Staphylococcus aureus subsp. aureus Mu50
ugcugguuuguuuaucguaggugcuggugauguugcugauaaauuuggucgcgucaaaauuacuuauguaggauugauauuaaauguuguagguucauuacucaucaucauuacaccuuugccagca

SEQ ID NO: 4250694 - RNA, 83 nt, Staphylococcus aureus subsp. aureus Mu50
gagaugguuuucaaucuggaucgugcugcuauugaauucgguaaaauggauuucaauacacauuuagauuuaaaagcauacuc

SEQ ID NO: 4250695 - RNA, 70 nt, Staphylococcus aureus subsp. aureus Mu50
gauguguugcaguuuuugaauuuucaauaucaauaaaguaauaauggaauuuaagacgcugcaugacauc

SEQ ID NO: 4250696 - RNA, 94 nt, Staphylococcus aureus subsp. aureus Mu50
gcaucuuuucuuucuaaaguaagguaauaguuaccaaguaccauaucuugugaugguguaacuacagguuuaccaucuuuaggguucaagaugu

SEQ ID NO: 4250697 - RNA, 120 nt, Staphylococcus aureus subsp. aureus Mu50
uagcuguaauugcgauuaguuauuuagagaagcuagauguuacaaauauuaaagaagcauuagaaacguuuggugguguuaaacgucguuucaaugaaacuacaauugcaaaucaaguua

SEQ ID NO: 4250698 - RNA, 61 nt, Staphylococcus aureus subsp. aureus Mu50
cauaucauuaauugcacuaccaaugauuauuguuaauagcguugguacggcgauuuuuaug

SEQ ID NO: 4250699 - RNA, 56 nt, Staphylococcus aureus subsp. aureus Mu50
aaagcaaucugagccuguaccgcacgaagugaaagguacagguucagacuugcuuu

SEQ ID NO: 4250700 - RNA, 83 nt, Staphylococcus aureus subsp. aureus Mu50
gauucaaucgguuucaaaggcugugcaauauauggcuaaaagacguauaggugcauuaauugucuuugaaaaagaaacagguc

SEQ ID NO: 4250701 - RNA, 67 nt, Staphylococcus aureus subsp. aureus Mu50
auacauuugcuuggugacuaggaaaagccguuugauaaaaguggcuaauaucaucagcagaauguau

SEQ ID NO: 4250702 - RNA, 61 nt, Staphylococcus aureus subsp. aureus Mu50
uuuaucaauugauuucauggauguuucuaguuaucacggaggcacugagucaacuggugaa

SEQ ID NO: 4250703 - RNA, 70 nt, Staphylococcus aureus subsp. aureus Mu50
uuaggauauggcguuacgcacuaugcugcguuugguagagaugguagucguauggugaugcaaauuuuaa

SEQ ID NO: 4250704 - RNA, 65 nt, Staphylococcus aureus subsp. aureus Mu50
aaugaaggugaaguuaccacacguguacgcauaucgugaacaaguuggaacauuucgucuucauu

SEQ ID NO: 4250705 - RNA, 71 nt, Staphylococcus aureus subsp. aureus Mu50
ucuaguuacuuuaugauuacuaaaaaugaugaagauuauuuuaugguuggugaugaugagguaaccaaaga

SEQ ID NO: 4250706 - RNA, 80 nt, Staphylococcus aureus subsp. aureus Mu50
cuauaguuacaugagacaccaugguuaugcugaccguuuaguacucgauaaaaauaaacauguuguuucugaaacuacag

SEQ ID NO: 4250707 - RNA, 56 nt, Staphylococcus aureus subsp. aureus Mu50
cugcaguauuaccauugcuuaaucucacugaacuugaaguaguugaagugcuguag

SEQ ID NO: 4250708 - RNA, 97 nt, Staphylococcus aureus subsp. aureus Mu50
uugauguuagguguuagcuauucuagaugaguuucuuagauguggaugccugucuugaugaaguuaucuaugauguuaauauaauacuugauguuga

SEQ ID NO: 4250709 - RNA, 71 nt, Staphylococcus aureus subsp. aureus Mu50
cgguugucauuauuguguugauauccauaaaaaagaauuaaaggaauuggguguaacacaaaugaaaauug

SEQ ID NO: 4250710 - RNA, 57 nt, Staphylococcus aureus subsp. aureus Mu50
aggcaugaguuaaauuaagcugugaugguuaccaacacagucuauuugcucgugucu

SEQ ID NO: 4250711 - RNA, 93 nt, Staphylococcus aureus subsp. aureus Mu50
caguguuaauaguuaauuucacauuuggauauuuacgaacgauuucagcguucagauccagucgauguggauuggcauuaauuucuaauacug

SEQ ID NO: 4250712 - RNA, 68 nt, Staphylococcus aureus subsp. aureus Mu50
ggauacagaaauguagcuaacauuuucccaauaaauguugaaagaaaugauauaguuacagcuguucc

SEQ ID NO: 4250713 - RNA, 58 nt, Staphylococcus aureus subsp. aureus Mu50
gaggcaauuaauccaaauaauccauuaaaaucaucggguuuuggagaugauuggcuuc

SEQ ID NO: 4250714 - RNA, 63 nt, Staphylococcus aureus subsp. aureus Mu50
uaaauagaaacagcaguaagaugauuucaaaugugaaagucauccuacugcuguuuuuauuug

SEQ ID NO: 4250715 - RNA, 61 nt, Staphylococcus aureus subsp. aureus Mu50
gucaacauagcacugauaauuccuaaaauagcuacuauacguggaauugucaugcucggau

SEQ ID NO: 4250716 - RNA, 87 nt, Staphylococcus aureus subsp. aureus Mu50
cacauaaaguaucaccaguaccuguaucuuuaagaccuaccgcagccgcgauaucuccagaguauacaguaucgauuucuugacgug

SEQ ID NO: 4250717 - RNA, 59 nt, Staphylococcus aureus subsp. aureus Mu50
uuaauuguucagcuaccugcauugccaauucucuuguaggugcuaaaaucaacgauuga

SEQ ID NO: 4250718 - RNA, 129 nt, Staphylococcus aureus subsp. aureus Mu50
aacuauaucuuuuuagccaaucuuauuauguauguuguguuugcgcuugucgcgguaacgcaauuuaauauugaaauuaaugcgaaaguuaaauauccaacucauuuagauauuacugguaaaaagaau

SEQ ID NO: 4250719 - RNA, 89 nt, Staphylococcus aureus subsp. aureus Mu50
uugucuaauugauuaaggcgaauggcuuucaauaaaaagacucguuuuuuauagugaagguaguuugaaaauaaugaauauaaagauga

SEQ ID NO: 4250720 - RNA, 77 nt, Staphylococcus aureus subsp. aureus Mu50
uuggcauaugcaacaaauugguuaccuggaccuacaaucuuaucaacuuuagguaucguuucuguuccauaagucaa

SEQ ID NO: 4250721 - RNA, 75 nt, Staphylococcus aureus subsp. aureus Mu50
augccguauguuauaugagacggggucauuucuugaauuaagagaagaaacaauugucuuauugaaaacuggcau

SEQ ID NO: 4250722 - RNA, 86 nt, Staphylococcus aureus subsp. aureus Mu50
uuuaaauuugaagauaacaaaaacgugcguagcuuuuaaaucaccgaaauguuauucgcuuaacguuuuguuguuguuauuuuaaa

SEQ ID NO: 4250723 - RNA, 85 nt, Staphylococcus aureus subsp. aureus Mu50
uacuguauauaaagaucaacauuuuacaauguuugaaacggacgcugaauuauucggauauuguuaugguguugcugguacagua

SEQ ID NO: 4250724 - RNA, 98 nt, Staphylococcus aureus subsp. aureus Mu50
gaagauuuguauucucaacuaagucaaccuuauugauaauggugugagaauauuuguucgagauggaugaaggugauuagugagaaacuggaauuuuc

SEQ ID NO: 4250725 - RNA, 100 nt, Staphylococcus aureus subsp. aureus Mu50
cuuaaaagacacuuuacgcagacucaauuauccaguuuugugcgcuaauauuuaugaaaaugauaguacauugacugauaacggugugcaguauuuucag

SEQ ID NO: 4250726 - RNA, 57 nt, Staphylococcus aureus subsp. aureus Mu50
uaauuuaaacaagcaguaagcuuucacauuguuggggcuuauugcuuuuuuacguug

SEQ ID NO: 4250727 - RNA, 60 nt, Staphylococcus aureus subsp. aureus Mu50
uuaaagcuuuaauugucaguacuugggagaauauaaaaggugugauacaaggagcuuuaa

SEQ ID NO: 4250728 - RNA, 66 nt, Staphylococcus aureus subsp. aureus Mu50
auuugaaaggagccgauaaugguguuaucaauuagaagucaaaucauuauuggcgucguuucgagu

SEQ ID NO: 4250729 - RNA, 96 nt, Staphylococcus aureus subsp. aureus Mu50
ugaaucugggacauaaacuaaugaaaugcucccuucaaaguagacauugaaaaaaugaaaacuuugaagggagcauuuuacaaugucuaagacuca

SEQ ID NO: 4250730 - RNA, 67 nt, Staphylococcus aureus subsp. aureus Mu50
ugcaaguuggggugggacgacgaaauauauuuugcgaaaauaucauuucugucccacucccuaugca

SEQ ID NO: 4250731 - RNA, 61 nt, Staphylococcus aureus subsp. aureus Mu50
gcauuuuugcgagauacguuaaagucagcggcaguuacuuuagguacaucugcaagauugc

SEQ ID NO: 4250732 - RNA, 65 nt, Staphylococcus aureus subsp. aureus Mu50
ccuaaggauaguaaauaugucguaacuuguacgcaugaaaguuauaacgaaguuauuaugcuagg

SEQ ID NO: 4250733 - RNA, 67 nt, Staphylococcus aureus subsp. aureus Mu50
uuaagcaaccuauagauuauuuugucgcgccagucagcacgacagguagcauuauggguaugaguag

SEQ ID NO: 4250734 - RNA, 66 nt, Staphylococcus aureus subsp. aureus Mu50
aaaagaugguaacuauuauauggaagguaucuuagaugauauacaaccagaugguuaugguuuuuu

SEQ ID NO: 4250735 - RNA, 67 nt, Staphylococcus aureus subsp. aureus Mu50
aaaacagcuuaaugauguaaugaaauuagugaguuaaucacugacuucaacgucauugagcuguuuu

SEQ ID NO: 4250736 - RNA, 71 nt, Staphylococcus aureus subsp. aureus Mu50
aaagcaacaauaacauuaucacugaaugcuaaaucuaaagaaacuucaguagaagauguuauuggugcuuu

SEQ ID NO: 4250737 - RNA, 81 nt, Staphylococcus aureus subsp. aureus Mu50
uucguaauugucuuuauaaaaaaaucccucaauccgaauugaauuuucggauugagggauuuuuauaguucuauugcagaa

SEQ ID NO: 4250738 - RNA, 68 nt, Staphylococcus aureus subsp. aureus Mu50
aaguacgucaaucguuauaucgcauagucaaucauuggauagacuucggcguugaugguuuucgauuu

SEQ ID NO: 4250739 - RNA, 56 nt, Staphylococcus aureus subsp. aureus Mu50
guauuguucaggugucgcauuugucacuagaugaccuaacgcccacgugacaauau

SEQ ID NO: 4250740 - RNA, 59 nt, Staphylococcus aureus subsp. aureus Mu50
aaagacuaguguaccuuguuucaagcuuaauaagcugaaauaagguauggcuagucuuu

SEQ ID NO: 4250741 - RNA, 88 nt, Staphylococcus aureus subsp. aureus Mu50
ucuauagaucaaucuagggagugggacagaaaugauauuuucgcaaaauuuauuucgucgucccaccccaacuugcauugucuguaga

SEQ ID NO: 4250742 - RNA, 69 nt, Staphylococcus aureus subsp. aureus Mu50
cauuagguuuaguaggagaaucggggugugguaaaucuacaacugguaaaucaauuauuaaacuuaaug

SEQ ID NO: 4250743 - RNA, 88 nt, Staphylococcus aureus subsp. aureus Mu50
aguugcaggcguguuaccgguauguauagguaaugcaacgagaguuagugauuauguuauggauaugggcaaagcuuaugaagcaacu

SEQ ID NO: 4250744 - RNA, 55 nt, Staphylococcus aureus subsp. aureus Mu50
accgaugauuuuauucggucacaugucaccauauaugauuguugggaugauuggu

SEQ ID NO: 4250745 - RNA, 58 nt, Staphylococcus aureus subsp. aureus Mu50
gaaaccugcaauaguaaauuuucugccauuauguacagaaucuacuauuguagguuuu

SEQ ID NO: 4250746 - RNA, 66 nt, Staphylococcus aureus subsp. aureus Mu50
gccaaugggagugggacagaaaugauauuuucgcaaaauuuauuucgucgucccaccccaacuugc

SEQ ID NO: 4250747 - RNA, 76 nt, Staphylococcus aureus subsp. aureus Mu50
ggcuguauucgaauaaauuuuucaucaacuaguauucggggggaauaaaguauauggaaauuuuacguauagagcc

SEQ ID NO: 4250748 - RNA, 65 nt, Staphylococcus aureus subsp. aureus Mu50
gucauagcuggaacuggaacuaaugauacugaaaagucaauccaagcuucauuccaagcuaaagc

SEQ ID NO: 4250749 - RNA, 67 nt, Staphylococcus aureus subsp. aureus Mu50
gcgaguuggggugggacgacgaaauaaauuuuacgaaaauaucauuucugucccacucccauggugc

SEQ ID NO: 4250750 - RNA, 67 nt, Staphylococcus aureus subsp. aureus Mu50
agcaaaauauauuacaggucaaacaauccauguaaaugguggaauguacauguaauauauuugagcu

SEQ ID NO: 4250751 - RNA, 71 nt, Staphylococcus aureus subsp. aureus Mu50
ggauauauugguaaguauuuaagugaagugauugaaaaugaugcugaacuuuuuacuauaucaaaauaucc

SEQ ID NO: 4250752 - RNA, 116 nt, Staphylococcus aureus subsp. aureus Mu50
ggauauaaauuaauguuuaauacauugcgugcaauguaucaacgacauccaauacguguugauauugccgguaguguagaaaguauauacgauauuacaaaagaugauuuguaucu

SEQ ID NO: 4250753 - RNA, 67 nt, Staphylococcus aureus subsp. aureus Mu50
aucagguauuguaauaaguguaauuuguuguuuauuaauaacaggaauauuguauuauacacuugau

SEQ ID NO: 4250754 - RNA, 62 nt, Staphylococcus aureus subsp. aureus Mu50
gauauguacauuauuguaaguuauggugugaaaauaucugaaguugccaauaauguacaauc

SEQ ID NO: 4250755 - RNA, 68 nt, Staphylococcus aureus subsp. aureus Mu50
uugauaguuuguuaccuuuauuagaugauggagauauuuuaauugauggugguaauacaaacuaucaa

SEQ ID NO: 4250756 - RNA, 89 nt, Staphylococcus aureus subsp. aureus Mu50
cuuaccauauagacauuuuguugugguuggauuucuaaaguuuuaaggucaccuuuuuccaacuucucaguaaauugauuauauguaag

SEQ ID NO: 4250757 - RNA, 84 nt, Staphylococcus aureus subsp. aureus Mu50
ucgugaauuagaaagugaucuuaaagaagggugcgacaugaugauuguuaaaccugcucuaaguuauuuagacauaguucgaga

SEQ ID NO: 4250758 - RNA, 74 nt, Staphylococcus aureus subsp. aureus Mu50
uccauggaauuggagugauggcauaggacaaucggugauguauggauuguaugccauuacuaauuuuauuugga

SEQ ID NO: 4250759 - RNA, 74 nt, Staphylococcus aureus subsp. aureus Mu50
uaauacaauuuauugacgcgcgugaaucucuuuuauaagaguguguagggaauggcguuguauaaauuguauua

SEQ ID NO: 4250760 - RNA, 77 nt, Staphylococcus aureus subsp. aureus Mu50
uacacauaggcgcacuugucuccuuuaguuuggguuuggucacuuuaaauuauagaggcaauugcgcuuuuugugua

SEQ ID NO: 4250761 - RNA, 88 nt, Staphylococcus aureus subsp. aureus Mu50
uuuagacuuaaaccaaccauuugauguaacugaaacuaaagguaacuaugauguuuuaguuaacguucaugguggugguuucacugga

SEQ ID NO: 4250762 - RNA, 55 nt, Staphylococcus aureus subsp. aureus Mu50
gugguaguguaucaccugucgaacuugcaaacauugcagguguagacauuacuac

SEQ ID NO: 4250763 - RNA, 75 nt, Staphylococcus aureus subsp. aureus Mu50
gacauuuauauuuuagguaaggcauuggguggcggcuuauacccuguaucugcuguacuugcaaauaaugauguc

SEQ ID NO: 4250764 - RNA, 69 nt, Staphylococcus aureus subsp. aureus Mu50
caaauauguugcaagaacguuuagggacgggcaaaguugccucuauggaucaacuugcagcauguucug

SEQ ID NO: 4250765 - RNA, 70 nt, Staphylococcus aureus subsp. aureus Mu50
guaucaauaaugaauaugcuggucaagucgauguaaugccaacaauuuuacauuuggcugguauagauac

SEQ ID NO: 4250766 - RNA, 60 nt, Staphylococcus aureus subsp. aureus Mu50
gauuaccgcugaaaauggaauuaaguccuuaaauacuugugaaauauucggcgguacuuc

SEQ ID NO: 4250767 - RNA, 68 nt, Staphylococcus aureus subsp. aureus Mu50
gaugauugcugcugaagagagauauguauuauuggaaaauggaaaaauguucucuacggguaaucauc

SEQ ID NO: 4250768 - RNA, 129 nt, Staphylococcus aureus subsp. aureus Mu50
uguucagauuuguauuuugcgcuucuaguagcuugaauagugagcguauuauuauugaaaucgauacuaauaucuucuuuauuuacaccugcuaguucagcuucuaaguaauauaauucgucuguuuca

SEQ ID NO: 4250769 - RNA, 81 nt, Staphylococcus aureus subsp. aureus Mu50
uaccaauuucagcacgacgauuaaauacaugauauguacauugaccccauguauauaaguuuuggugacugaauacuggug

SEQ ID NO: 4250770 - RNA, 70 nt, Staphylococcus aureus subsp. aureus Mu50
gcauuacagaagaugcacaacgcgguauggauaaauuauucaaccauguugcugagucauuugauaaagc

SEQ ID NO: 4250771 - RNA, 129 nt, Staphylococcus aureus subsp. aureus Mu50
auaugaggucaucuuaaguucuuuaaucucaauuguaaugguagcugucuugauauggauugcaauuaaaacauauaaagauucaguacuuacauuugaacguggcuuauuuaauucaaugaaacgugu

SEQ ID NO: 4250772 - RNA, 130 nt, Staphylococcus aureus subsp. aureus Mu50
gcgauuuuuauauuaagauuccaaugguuggacauguaaacaguuugaaugcuucgguugcagcaaguuuaaugauguacgaaguauuucgaaaaagacaugauguuggagaaauauaaugaaagaacgu

SEQ ID NO: 4250773 - RNA, 63 nt, Staphylococcus aureus subsp. aureus Mu50
gugcuugugaaaccugaaauucguaugccuaaaguugguggacgugucaugaguuuacaagac

SEQ ID NO: 4250774 - RNA, 84 nt, Staphylococcus aureus subsp. aureus Mu50
guuagaagacauuguguugaauucaucauuuuugccuuugucaauuuuugguucuugugguucuucagcaaaagucuuuuuaac

SEQ ID NO: 4250775 - RNA, 96 nt, Staphylococcus aureus subsp. aureus Mu50
auugguugcacagaaaaaccccaucuguuaaaguuauaagugacuaaacaaauaacuaaauagauggggguuucuuuuaauauuauguguccuaau

SEQ ID NO: 4250776 - RNA, 79 nt, Staphylococcus aureus subsp. aureus Mu50
gcugugcauuagcuguugagguauuaaaacguuuaaaagaugaaaauauuggaauuaacuuauacaguggugccacagu

SEQ ID NO: 4250777 - RNA, 65 nt, Staphylococcus aureus subsp. aureus Mu50
ggacguaagagauaaaauaaagagguacuagaauuaacuagugccucuuuuauuauuuaacgucu

SEQ ID NO: 4250778 - RNA, 77 nt, Staphylococcus aureus subsp. aureus Mu50
aggauaguaaauaugucguaacuuguacgcaugaaaguuauaacgaaguuauuaugcuagguauggcauuauauccu

SEQ ID NO: 4250779 - RNA, 61 nt, Staphylococcus aureus subsp. aureus Mu50
auuuagcacacuguuuaucguuucuauuuuuauuguagauauuuuguacggugugauagau

SEQ ID NO: 4250780 - RNA, 71 nt, Staphylococcus aureus subsp. aureus Mu50
ucaaaaucgaguauucaaugacaaugcguugauaauuuuguuaugauaauucauugaauauacgacaauga

SEQ ID NO: 4250781 - RNA, 57 nt, Staphylococcus aureus subsp. aureus Mu50
guacaaagagcaguaaaguuauuuucuauuagaaaaugucuuacugcuccuuuguau

SEQ ID NO: 4250782 - RNA, 124 nt, Staphylococcus aureus subsp. aureus Mu50
cuaccaaaaccagaauaaaacugaauauaguuauuuaagaacgcauguuauugauuagagacucuaauuuauagcaugcguuuuuugauugaugucgaaaguuuuguaaguggauuaggauuag

SEQ ID NO: 4250783 - RNA, 76 nt, Staphylococcus aureus subsp. aureus Mu50
agccgauuauuuaugguguauuagaugcgacucgauuuuuagaacgucaucaauauaccgaaaauacaguuucgcu

SEQ ID NO: 4250784 - RNA, 57 nt, Staphylococcus aureus subsp. aureus Mu50
gaguuuaaaaaagguuaaguacgaaaucaguaauuguacuuaaccuuuuuugaauuc

SEQ ID NO: 4250785 - RNA, 59 nt, Staphylococcus aureus subsp. aureus Mu50
aaauaaugugcacccuaaaaguugaagauaauuuuaacuuuauagggcgcacauuauuu

SEQ ID NO: 4250786 - RNA, 62 nt, Staphylococcus aureus subsp. aureus Mu50
ggauggauaggcauaaaagguaguuucgguuuaaaccaaauuuuagguguguuuauguaucc

SEQ ID NO: 4250787 - RNA, 107 nt, Staphylococcus aureus subsp. aureus Mu50
auuagguuuauaauauuaaaagcaugauacucaauaaaauuggaacacgaaauggugaacuaaauugaaugagugucaugcuuaauuuauguguugugauauauagu

SEQ ID NO: 4250788 - RNA, 60 nt, Staphylococcus aureus subsp. aureus Mu50
gaugguaucaauuugaugugugcguucaacaaacucgccaccuuuaaauaaaaugccauu

SEQ ID NO: 4250789 - RNA, 102 nt, Staphylococcus aureus subsp. aureus Mu50
ugucgugcguaacuguauaguuuuucaguuguauuuaaaguuaaguuaucuacuucgcgcuuuccuugccuuaauugugaaauuacauauugcgcuacgcca

SEQ ID NO: 4250790 - RNA, 129 nt, Staphylococcus aureus subsp. aureus Mu50
uuguaauguguuucaauacuuuuuggauagauugcgaaauuguauugaaucgucaucguuuuaaauuuuuaaaugagaauggaaugagcauuacaauauacaagcaaucaaaaguaaauacauucacaa

SEQ ID NO: 4250791 - RNA, 60 nt, Staphylococcus aureus subsp. aureus Mu50
guaguugacugaacgaaaaugcgcuuguaacaagcuuuuuucaauucuagucaaccuugc

SEQ ID NO: 4250792 - RNA, 73 nt, Staphylococcus aureus subsp. aureus Mu50
cuaagcauucuaauuugauguuuugauugauuaaaaguaguuaaaaucauagcgucugaucuagaguguucag

SEQ ID NO: 4250793 - RNA, 66 nt, Staphylococcus aureus subsp. aureus Mu50
cugcaaauguuacaccuguuucuucgccaggacgguugacugagaaacuugguguacguuuuaaag

SEQ ID NO: 4250794 - RNA, 65 nt, Staphylococcus aureus subsp. aureus Mu50
ggcaguaguugacugaacgaaaaugcgcuuguaacaagcuuuuuucaauucuagucaaccuugcc

SEQ ID NO: 4250795 - RNA, 77 nt, Staphylococcus aureus subsp. aureus Mu50
aacgucaguuauuaacaugauuacgaugaacauuauugaaacuguucauagucuucugucaugugauagcugacguu

SEQ ID NO: 4250796 - RNA, 57 nt, Staphylococcus aureus subsp. aureus Mu50
aagucucauaaagcuauugccuaaaaugauuauagguuauaugcugauaugaggcuu

SEQ ID NO: 4250797 - RNA, 100 nt, Staphylococcus aureus subsp. aureus Mu50
auaauuagagaaaauguaguuguguauguuuuguggucguuaaacuagauauaauuguccgauuuauaaaacauacauaaugaauacaaugauugauuau

SEQ ID NO: 4250798 - RNA, 64 nt, Staphylococcus aureus subsp. aureus Mu50
ccaacacuuaucaaucaagcuauugagcaaaauaucaaauuaaucgcuuguacgaugaguaugg

SEQ ID NO: 4250799 - RNA, 69 nt, Staphylococcus aureus subsp. aureus Mu50
uuggcaguaguugacugaacgaaaaugcgcuuguaacaagcuuuuuucaauucuagucaggggccccaa

SEQ ID NO: 4250800 - RNA, 59 nt, Staphylococcus aureus subsp. aureus Mu50
ggaucuauugcaucaugugacacguuaaacgauucaacaucgaaaccugcaauagauuu

SEQ ID NO: 4250801 - RNA, 55 nt, Staphylococcus aureus subsp. aureus Mu50
ugcgaugauugcacuuuggguuaacguauuaaugggaaucauggcauuuaucgca

SEQ ID NO: 4250802 - RNA, 66 nt, Staphylococcus aureus subsp. aureus Mu50
uauuauggaaagacaguaauuuggcuaaaauugcagcugaaacaaugaaaauuacugcccaugaua

SEQ ID NO: 4250803 - RNA, 80 nt, Staphylococcus aureus subsp. aureus Mu50
acuguuuuugaguuagauuuaagcgcauuaguagcgggcgcuaaauaucguggugaauuugaagagagauuaaaagcagu

SEQ ID NO: 4250804 - RNA, 78 nt, Staphylococcus aureus subsp. aureus Mu50
cguuuauucauuuugcagcaacuaugaauaaaaauguauuuaaaaauuuauggcuaauugccugggaaaugacauacg

SEQ ID NO: 4250805 - RNA, 60 nt, Staphylococcus aureus subsp. aureus Mu50
gcaucgacuucaucaauaaaaauaguaucaaagugcuguuugaaucgguaaaguugaugu

SEQ ID NO: 4250806 - RNA, 79 nt, Staphylococcus aureus subsp. aureus Mu50
aaauggauacaguuuagugcgcaaauuaauuaaugaaucaggcauugauuuggcaucaaacuucgauaaucguccauuu

SEQ ID NO: 4250807 - RNA, 57 nt, Staphylococcus aureus subsp. aureus Mu50
acaccaacaaaacagagguuuucgcuaaugauugcgaagaccucuguuuuuuggugu

SEQ ID NO: 4250808 - RNA, 93 nt, Staphylococcus aureus subsp. aureus Mu50
guucuuauuuauugauuucuuugauacagcugguacauuaguagcuguugcuacucaagcagguauuaugaaagauaauaaauuaccaagagc

SEQ ID NO: 4250809 - RNA, 65 nt, Staphylococcus aureus subsp. aureus Mu50
gcacuauuuguuaauaaauccauuucagguucaacuguuugcccuaauggauucgguaacaaugc

SEQ ID NO: 4250810 - RNA, 79 nt, Staphylococcus aureus subsp. aureus Mu50
acaaguugaaaaugaaggauucuaauaucauuucguuuauauauagcagacaugauagaauuuuauauguaaaucuugu

SEQ ID NO: 4250811 - RNA, 90 nt, Staphylococcus aureus subsp. aureus Mu50
uugcagaagaagcaggcgcgguagcaguuauggcauuagaacgaguaccuucugauauuagagcugcugguggcguugcacguauggcaa

SEQ ID NO: 4250812 - RNA, 65 nt, Staphylococcus aureus subsp. aureus Mu50
ggcaguaguugacugaacgaaaaugcgcuuguaacaagcuuuuuucaauucuagucaacuuugcc

SEQ ID NO: 4250813 - RNA, 129 nt, Staphylococcus aureus subsp. aureus Mu50
cgaugucuuuggcaagauucucaauuucagacacaugauucacagcaccauuugauccuggaaucacaggaacaccugcaugaugaacuguuugucuugcuguuauuuuaucccccaucauuuccaucg

SEQ ID NO: 4250814 - RNA, 81 nt, Staphylococcus aureus subsp. aureus Mu50
ccugaauauuauuuauaaggagugagugacgaugaaaagguuaagcauaaucgucaucauuggaaucuuuauaauuacagg

SEQ ID NO: 4250815 - RNA, 86 nt, Staphylococcus aureus subsp. aureus Mu50
gaacugcuauauacaaacgugcauauuauaaguaucucuaaauauuuuggagaacuuaaauugcgcuuauaaguauguagcgguuu

SEQ ID NO: 4250816 - RNA, 59 nt, Staphylococcus aureus subsp. aureus Mu50
ucaaauuacgugcuaaagcuugagauaucaauauuuauuggcgauagaguguaauuuga

SEQ ID NO: 4250817 - RNA, 107 nt, Staphylococcus aureus subsp. aureus Mu50
ugagaugggcucaagggggacacgaaguauuacuacgagacuuuuuuagcacaaugaaaacgaaaagguuuccuuuauauauuuugauguuugagcaaaucaucuca

SEQ ID NO: 4250818 - RNA, 86 nt, Staphylococcus aureus subsp. aureus Mu50
aaauagaaacgcaauccacaaaaauggcaagcacuaaaauaauguuugggagugcuugugcuuuuguggauugcggucgauuauuu

SEQ ID NO: 4250819 - RNA, 82 nt, Staphylococcus aureus subsp. aureus Mu50
aagauacuaauauuuuuccauauacugguguaguugcuuuuaaaagugcaacuggauuuguaguuggaaagaauacuauuuu

SEQ ID NO: 4250820 - RNA, 66 nt, Staphylococcus aureus subsp. aureus Mu50
auuuguuuguaucguucgaggauucacuguucgaauucugaaguugucuccaacgugcgaauaagu

SEQ ID NO: 4250821 - RNA, 65 nt, Staphylococcus aureus subsp. aureus Mu50
uacaagcaaaaguagcggugauuguuaaaauugaugguaaacaaucaccgcuauuuuugcuugug

SEQ ID NO: 4250822 - RNA, 74 nt, Staphylococcus aureus subsp. aureus Mu50
cacuagauauaaagcuaaagcgacaaauaccaacguaaucguugcaauuauuguugcuuuagguuguauuuuug

SEQ ID NO: 4250823 - RNA, 66 nt, Staphylococcus aureus subsp. aureus Mu50
aggagguauguaagugaauauagaauauaaaaaagguauauuuuuagcacucagugcauacauucu

SEQ ID NO: 4250824 - RNA, 76 nt, Staphylococcus aureus subsp. aureus Mu50
caaaacaaacgugggagugggacagaaaugauauuuucgcaaaauuuauuucguugucccaccccaacuugcauug

SEQ ID NO: 4250825 - RNA, 64 nt, Staphylococcus aureus subsp. aureus Mu50
uuaguauucauauaaauagucuuuaaauagaaauaggagggagacauuuaaugauaaauacuga

SEQ ID NO: 4250826 - RNA, 58 nt, Staphylococcus aureus subsp. aureus Mu50
agauuauggguauaguuugcuauugacagguguuaaagcuacugauacuauguagucu

SEQ ID NO: 4250827 - RNA, 102 nt, Staphylococcus aureus subsp. aureus Mu50
gacagucagguuuaaguuuaaaagcuuuaauuacuuuagccauugcuaccuucguugaaggugccugaucuguaauuaccuuuugagguuuaccaaauuguu

SEQ ID NO: 4250828 - RNA, 72 nt, Staphylococcus aureus subsp. aureus Mu50
aaauuaagagucaguaaaaagaccucguuacauuuaugguguacgaggucuuuaauuuauuuauuuugauuu

SEQ ID NO: 4250829 - RNA, 67 nt, Staphylococcus aureus subsp. aureus Mu50
augccaaauacuaucgaggcgacgaagucaacuuuacaaugggagucucugauagacauucugguau

SEQ ID NO: 4250830 - RNA, 62 nt, Staphylococcus aureus subsp. aureus Mu50
ugccuuauauucagauguaaacggcgauuauauuaaaaagccaauuacagaauguaguggua

SEQ ID NO: 4250831 - RNA, 74 nt, Staphylococcus aureus subsp. aureus Mu50
cuuuguagguauucgauuggauucuggagauaucgcuuauuuaucuaaagaggcaagacguaugcuugaugaag

SEQ ID NO: 4250832 - RNA, 72 nt, Staphylococcus aureus subsp. aureus Mu50
gcaauucggaaaaaaucgauuggcguggcuucagugcuuguagguacguuaaucgguuuuggacuacucagc

SEQ ID NO: 4250833 - RNA, 65 nt, Staphylococcus aureus subsp. aureus Mu50
aaaaacaucgagucagaaaaaggugguuauugaaaccacuaacuagcaucugacucgauguuuuu

SEQ ID NO: 4250834 - RNA, 81 nt, Staphylococcus aureus subsp. aureus Mu50
cacuuguuaaauguucuuuaaaccaaucguauguguuaauuuuauuauaagucacacauggugaaaagacauuaacgaaug

SEQ ID NO: 4250835 - RNA, 68 nt, Staphylococcus aureus subsp. aureus Mu50
aguuuuaagcaauugauauuacuaaguguauuuuuaggugaauuaucaguaauauuaggcuuaguccu

SEQ ID NO: 4250836 - RNA, 84 nt, Staphylococcus aureus subsp. aureus Mu50
cuuuagcauugggauuauuaucaacaguaggugcagcuuuaccgagucaugaagcaucugcagauaguaauaacgguuauaagg

SEQ ID NO: 4250837 - RNA, 65 nt, Staphylococcus aureus subsp. aureus Mu50
gugggacagaaaugauaaagaaucacuaaugauuuauuauguagugguucuuugucauuagccac

SEQ ID NO: 4250838 - RNA, 96 nt, Staphylococcus aureus subsp. aureus Mu50
ugaacaaugagaccuaagccaacaaaguugagugcauauugauuauuuauuuuaauuacaucguauguaccaacuugugcagaaaucauuuguuca

SEQ ID NO: 4250839 - RNA, 115 nt, Staphylococcus aureus subsp. aureus Mu50
aaaacuuccauuggcauguauguuguaaaggugcauguaauguugaacgccaaaugauacggcguucagauuacauuagcaucuauacguuaacagcauaaccaauggaaguuuu

SEQ ID NO: 4250840 - RNA, 72 nt, Staphylococcus aureus subsp. aureus Mu50
uagcuauuuguaacucuuauauugauauuguuccuggacauguucacuugagagagcuugcagauauagcua

SEQ ID NO: 4250841 - RNA, 93 nt, Staphylococcus aureus subsp. aureus Mu50
uuggcguuauuuuugccguuuggauuuuaaguauugucgaaaagagauugcauaaaauugugccaaaugcgauugauauuauuguaacgccga

SEQ ID NO: 4250842 - RNA, 58 nt, Staphylococcus aureus subsp. aureus Mu50
guaaaauggcugaagcauuugucuuagcacaugaauuaggucaugcaggucauuuuac

SEQ ID NO: 4250843 - RNA, 64 nt, Staphylococcus aureus subsp. aureus Mu50
uuuaacgguaucaacguuugccggugaaucucaugcacaaacuaaaaacguugaagcugcuaaa

SEQ ID NO: 4250844 - RNA, 76 nt, Staphylococcus aureus subsp. aureus Mu50
aggaggacaacauagugaguuuguuacauauugcggugauauuaccguuaauauucgcacucauuauuccuauccu

SEQ ID NO: 4250845 - RNA, 55 nt, Staphylococcus aureus subsp. aureus Mu50
uacaaagccuuaauaucaugcacaauauucguagcaugacauuaaggcuuuagua

SEQ ID NO: 4250846 - RNA, 65 nt, Staphylococcus aureus subsp. aureus Mu50
guuuguucagacguuuguucaucuuugccaaauuggcuacucagaauaacaaaugcugggcguac

SEQ ID NO: 4250847 - RNA, 70 nt, Staphylococcus aureus subsp. aureus Mu50
agguguggaacagacauguguuauacgggaaauugggcgaaccgcaacuauuauacauugauuuacaccu

SEQ ID NO: 4250848 - RNA, 61 nt, Staphylococcus aureus subsp. aureus Mu50
aaauccaccugcaacuguagacaaucaucgugauuguccuaacgaguugcuaggugcuuuu

SEQ ID NO: 4250849 - RNA, 93 nt, Staphylococcus aureus subsp. aureus Mu50
auucgguguuagauguacggacuguucauugacaaggacugauuucgcaucgaaaucaaugguuaauggaccauuugugaaacgacuuugaau

SEQ ID NO: 4250850 - RNA, 64 nt, Staphylococcus aureus subsp. aureus Mu50
accagaaguauaaaccauaccauucacaacuguugcaugcgaauaugguccaagugcuuccggu

SEQ ID NO: 4250851 - RNA, 66 nt, Staphylococcus aureus subsp. aureus Mu50
ugauugguggguuuuucuucaaguaguccaucauauauuuucuagcuaaaaggaaaccuccaauua

SEQ ID NO: 4250852 - RNA, 62 nt, Staphylococcus aureus subsp. aureus Mu50
ccgguucguaucuugauacucaucgaccaauauuucuugaaaguguugacgguaugauucgg

SEQ ID NO: 4250853 - RNA, 104 nt, Staphylococcus aureus subsp. aureus Mu50
caauacuaggaguagcuucagccauuaaauuguaaccauggugggugauuuauaucauuuuauaugauggucacaguuuauuugaugaaacuucuuuuacauug

SEQ ID NO: 4250854 - RNA, 70 nt, Staphylococcus aureus subsp. aureus Mu50
uucaaaaaagcacgcacgcuuuauaugucagaacagauaacugacuacaaaguaugcgugccuuuaugaa

SEQ ID NO: 4250855 - RNA, 60 nt, Staphylococcus aureus subsp. aureus Mu50
uauuuaugagcuaaucaaacaucauaauuuuuauggagaguuugauccuggcucaggaug

SEQ ID NO: 4250856 - RNA, 107 nt, Staphylococcus aureus subsp. aureus Mu50
uuaacaauauuauuagcgauuaguuccccuauuauuuaugacaauaugcagucaaucaaugaaacauguauguaugaguauauuuggaacuaguaauguauuguuaa

SEQ ID NO: 4250857 - RNA, 81 nt, Staphylococcus aureus subsp. aureus Mu50
cugagacacguacaaugaaggcgaaugaugucaaaauagaugggaaucaauucguuugucguuucaauguagcuaucuuag

SEQ ID NO: 4250858 - RNA, 61 nt, Staphylococcus aureus subsp. aureus Mu50
guauguaguacauaaaaaagagcggcauccauugucgcuccuuuuuauuauguauuuuuac

SEQ ID NO: 4250859 - RNA, 73 nt, Staphylococcus aureus subsp. aureus Mu50
aguaaaugaacuggacgauauugcgauuauugguacaggccuugccaguuuagauguuguccguuauguugcu

SEQ ID NO: 4250860 - RNA, 70 nt, Staphylococcus aureus subsp. aureus Mu50
uguuggggccccugacuagaguugaaaaaagcuuguugcaagcgcauuuucauucagucaacuacuagca

SEQ ID NO: 4250861 - RNA, 55 nt, Staphylococcus aureus subsp. aureus Mu50
ugggagugggacagaaaugauauuuucgaaaaauuuauuucgucgucccaccccg

SEQ ID NO: 4250862 - RNA, 76 nt, Staphylococcus aureus subsp. aureus Mu50
aguuggaccaaaaggcauuaucagaagaaugguugacacaaaaaaauuaacuucaaugauuuuuuaugguccaccu

SEQ ID NO: 4250863 - RNA, 71 nt, Staphylococcus aureus subsp. aureus Mu50
ggaugguacugaauaccguaaugcggucuuucuuuaugcucaaaugacuguauacaaucuucgguacgucc

SEQ ID NO: 4250864 - RNA, 86 nt, Staphylococcus aureus subsp. aureus Mu50
uaaagauaaaaaagcacagccaugauauacgaauguugcauguuauaugcuaaaccuucauaucauagcuguguuugauucauuua

SEQ ID NO: 4250865 - RNA, 124 nt, Staphylococcus aureus subsp. aureus Mu50
agcaguagcguauugguggguagcuggauucuuaggauuccaucuaauucgguacaauguguuuugaccuuuauugauguaauccuuucuuacgaagcuagcaccgcccaugauugcuuuugcu

SEQ ID NO: 4250866 - RNA, 92 nt, Staphylococcus aureus subsp. aureus Mu50
cauugccacaaaagaaacaagugcaaucauuaacaacgaaaagauuagugauaagagcacaaucuuucguguugauuucuuuuuagguuuug

SEQ ID NO: 4250867 - RNA, 76 nt, Staphylococcus aureus subsp. aureus Mu50
uauguuggggccccugacuagaauugaaaaaacuuguuacaagugcauuuucguucagucaacuacugccaauaua

SEQ ID NO: 4250868 - RNA, 70 nt, Staphylococcus aureus subsp. aureus Mu50
aucugaaaaaacaguucaugaugaugcacguauugauuauguaagacaacauuugaacguuauugcagau

SEQ ID NO: 4250869 - RNA, 68 nt, Staphylococcus aureus subsp. aureus Mu50
caggaccuaguuaugaguuaacaaauguuaguggccaaagucaagguuauuaugacucuaacguuuug

SEQ ID NO: 4250870 - RNA, 59 nt, Staphylococcus aureus subsp. aureus Mu50
accagcuaaauuacuaccuucagucaacgucccuguuacugauacaguguuugacuggu

SEQ ID NO: 4250871 - RNA, 71 nt, Staphylococcus aureus subsp. aureus Mu50
caacuguauaaggaggcauugaaccgugaugcagaguaguaaauggaaugcaaugucucuuuuaauggaug

SEQ ID NO: 4250872 - RNA, 130 nt, Staphylococcus aureus subsp. aureus Mu50
uaucaugauuggguaauaccuuuugugccggaauggaugguugugauuuaucaacaucauucgauugugacguugucgauugugauccauuacguucagcaugauggguauuuugaaccugaucauuuug

SEQ ID NO: 4250873 - RNA, 78 nt, Staphylococcus aureus subsp. aureus Mu50
uugcaauggcguucuucuuacugccuagaacauuaacguuguucuauccagauaaagaaugggcacaaaacauugcga

SEQ ID NO: 4250874 - RNA, 55 nt, Staphylococcus aureus subsp. aureus Mu50
auuuugaugagcgugcaauacuuaauaguaauugagcguaugccgcuuucgaaau

SEQ ID NO: 4250875 - RNA, 129 nt, Staphylococcus aureus subsp. aureus Mu50
uacgacguuuggugccuuuuuuaaaauauggauugucauaggauuaguuauuaucgguacuuaugcauuuuuuguagguauaagugaaauaauuauuaguauauugcagcagguaucaaaaguuuacua

SEQ ID NO: 4250876 - RNA, 65 nt, Staphylococcus aureus subsp. aureus Mu50
ggcaguaguugacugaaugaaaaugcgcuuguaacaagcuuuuuucaauucuagucaaccuugcc

SEQ ID NO: 4250877 - RNA, 59 nt, Staphylococcus aureus subsp. aureus Mu50
gaaggugguaauaacguuauuaaauuaaguacaggugaugacguuguugaauuaucuuc

SEQ ID NO: 4250878 - RNA, 55 nt, Staphylococcus aureus subsp. aureus Mu50
uggggugggacgacgaaauaaauuuugcgaaaauaucauuucugucccacuccca

SEQ ID NO: 4250879 - RNA, 74 nt, Staphylococcus aureus subsp. aureus Mu50
cuguagaugaacuuaauuugaugacagaacgugauauucaauuauaugacgauaucaauuuaaguuugccugag

SEQ ID NO: 4250880 - RNA, 75 nt, Staphylococcus aureus subsp. aureus Mu50
cgguugaaaugauguuaucaaacauugaagucauuguuggugauuucgaguguauggaugauguuguuuuaccug

SEQ ID NO: 4250881 - RNA, 59 nt, Staphylococcus aureus subsp. aureus Mu50
aaucacuagagcuaugaaacuuggugcuaaagguaucaaaacucaaguaucuggucguu

SEQ ID NO: 4250882 - RNA, 129 nt, Staphylococcus aureus subsp. aureus Mu50
uaguugguccaaacgauaauguuguuagaaugaugacaauucauaguaguaaaggucuagaguuuccauuugucauuuauucuggauugucaaaagauuuuaauaaacgugauuugaaacaaccaguua

SEQ ID NO: 4250883 - RNA, 94 nt, Staphylococcus aureus subsp. aureus Mu50
aacacgacucaucaacaauugacguuuuagcaguaaaagugccauugcauucuaagcauuuaaaacguuguuuagcuaaguugagguauguguu

SEQ ID NO: 4250884 - RNA, 72 nt, Staphylococcus aureus subsp. aureus Mu50
ucguagaaaaugagagcccccuuuaccacaacauguaaaugcauauugugaaaagggggcuuuuauuuauga

SEQ ID NO: 4250885 - RNA, 76 nt, Staphylococcus aureus subsp. aureus Mu50
aaugacaccuaaagaguuaacaacugagauaccggcugguacgaagaguaagccaauguuauuuguuagugucguu

SEQ ID NO: 4250886 - RNA, 59 nt, Staphylococcus aureus subsp. aureus Mu50
accagcuacaguaguugcauuuuguacuuguuguuuuaaugcaucuuucugugcuuggu

SEQ ID NO: 4250887 - RNA, 70 nt, Staphylococcus aureus subsp. aureus Mu50
aaaagaccuucacauguaaagggaaauagcgauucguuucgucuugucuccuacauguugaaggucuuuu

SEQ ID NO: 4250888 - RNA, 100 nt, Staphylococcus aureus subsp. aureus Mu50
uaucuaauuuauacauuuauaaacuagcagugauugcaaauaugaaguuacaaaguuuaaguucaugcggagauauugcugugaguguauauaguggaug

SEQ ID NO: 4250889 - RNA, 63 nt, Staphylococcus aureus subsp. aureus Mu50
ggccccugacuagaauugaaaaaagcuuguuacaagcgcauuuucguucagucaacuacugcc

SEQ ID NO: 4250890 - RNA, 129 nt, Staphylococcus aureus subsp. aureus Mu50
aucaaugcuauaauuaauuacauaauaaauugaacaucuaaauacaccaaauccccucacuacugccauagugaggggauuuauuuagguguugguuauuugucaccuuuuuuauuguugcgcguucgu

SEQ ID NO: 4250891 - RNA, 67 nt, Staphylococcus aureus subsp. aureus Mu50
uugcugaagaacaaggacuuguuacugcuaagaaaaaagauucuacaggcauuuguuuuaucggcga

SEQ ID NO: 4250892 - RNA, 92 nt, Staphylococcus aureus subsp. aureus Mu50
ugauguucacauugaauucacaccaaacgaaacaggcgcagguuucgaauucgaaaacgcuaucguuggugguguaguuccucgugaauaca

SEQ ID NO: 4250893 - RNA, 83 nt, Staphylococcus aureus subsp. aureus Mu50
gaugaaguguuuguuggccguauacguagagaugauucauuagaaaauacuuuccauguaugguguacaucagacaauuuauu

SEQ ID NO: 4250894 - RNA, 55 nt, Staphylococcus aureus subsp. aureus Mu50
uaggggcaguacgaucgaucguguuguucuugacacuuuugucgucucguccuug

SEQ ID NO: 4250895 - RNA, 55 nt, Staphylococcus aureus subsp. aureus Mu50
gauuaaguucuuuaacuucaucuugagauaaagaagaagcugaagcgacuuuguc

SEQ ID NO: 4250896 - RNA, 110 nt, Staphylococcus aureus subsp. aureus Mu50
cguuaacaccuugagacucaauguauugacugugauuuggaguguauaaugcuacuguuuugucuauagccaucgcaucaaauauuauauuugaguaaucagugauaacg

SEQ ID NO: 4250897 - RNA, 72 nt, Staphylococcus aureus subsp. aureus Mu50
gauaaaauuaaaagccaaucaaugggaaauguugacuucaacacuccguuugauuggcuuuuauaauguguu

SEQ ID NO: 4250898 - RNA, 66 nt, Staphylococcus aureus subsp. aureus Mu50
uuuguacaggugagucugcuucagguucccuaauaucuguagcaagaacauuaucugucccauaaa

SEQ ID NO: 4250899 - RNA, 90 nt, Staphylococcus aureus subsp. aureus Mu50
augaagaauaaucaaauaaaaccacguaucauguuuuaguauggugaugaugccauauacaugaugcgugguucuuuguuauguugucau

SEQ ID NO: 4250900 - RNA, 62 nt, Staphylococcus aureus subsp. aureus Mu50
uacgcucucaguagucaucuuuaaaucguuucuuuuagagaugacuucauuuugagagcgua

SEQ ID NO: 4250901 - RNA, 58 nt, Staphylococcus aureus subsp. aureus Mu50
augcauauucaacuagcucagguuuacucuuuaagccaagcuuugucauaauaugcgu

SEQ ID NO: 4250902 - RNA, 63 nt, Staphylococcus aureus subsp. aureus Mu50
acaaaagaggugccacaaacauguuauuuuguucauccaaacauguuguggcgccucuuuugu

SEQ ID NO: 4250903 - RNA, 87 nt, Staphylococcus aureus subsp. aureus Mu50
uuaaaaaaccugaaacaaauuaguuugauaugcucucuucaaaguagauauugaauggaguauaucagcuuguuucagguuuuauga

SEQ ID NO: 4250904 - RNA, 107 nt, Staphylococcus aureus subsp. aureus Mu50
cgaugcgugcuguugcuaagagugugacauuuucuacaggucacuuuaaagauucagaagaaaaugaaguagaugucaacgcuuuaguaaauggugguacguuggcg

SEQ ID NO: 4250905 - RNA, 70 nt, Staphylococcus aureus subsp. aureus Mu50
aucauaguaacuauuuagguguggcuugggaauuaauuaacccuguuaugcaaauuaugguuuacuggau

SEQ ID NO: 4250906 - RNA, 59 nt, Staphylococcus aureus subsp. aureus Mu50
cacagcuaugauaugaagguuuagcauauaacaugcaacauucguauaucauggcugug

SEQ ID NO: 4250907 - RNA, 122 nt, Staphylococcus aureus subsp. aureus Mu50
gcaccauauaaaucggcuaagugauuauuaaacgacuuaucgguuggccauuucuuaguugcucgaacuaauaauuugcuuaauaaugaucuagcuguaauugugucauauucuaaaggugc

SEQ ID NO: 4250908 - RNA, 58 nt, Staphylococcus aureus subsp. aureus Mu50
guuugacuucaguacaaucuuguagggaagauuuguaacaggaugguggggucauaac

SEQ ID NO: 4250909 - RNA, 130 nt, Staphylococcus aureus subsp. aureus Mu50
agauguuguagacuuauacauucaauacccagauauuguagauaaauuagcguuguuaaaaggucaagaauaugaaauugcaacaauuaaugaucuuacagaagcuuuugaagcagaccugucuacaucu

SEQ ID NO: 4250910 - RNA, 92 nt, Staphylococcus aureus subsp. aureus Mu50
uagcuacauuuggaugcucauaauagauucuauuuuuaaauuggucuguuacuucuuuaagguuagagucauuuggaucugcauaguagcua

SEQ ID NO: 4250911 - RNA, 59 nt, Staphylococcus aureus subsp. aureus Mu50
ucagggaaaacuggucaagaaauuuauaaugagaauuucuauggagggauuuuccguga

SEQ ID NO: 4250912 - RNA, 82 nt, Staphylococcus aureus subsp. aureus Mu50
ggcagacaucauuaauaugauugauacuacaucagaagguauucaaagugaaucggugauaagugaaucaauuaagucugcc

SEQ ID NO: 4250913 - RNA, 77 nt, Staphylococcus aureus subsp. aureus Mu50
aauauaccaauuguaacgaugauacaagauguauuuuaggguagaauauaucgcucauauguugcgaaugguguuuu

SEQ ID NO: 4250914 - RNA, 56 nt, Staphylococcus aureus subsp. aureus Mu50
ccguuuguaaaauagcaguguacucgcauuaguaaguacaaauuuauuuuacaggg

SEQ ID NO: 4250915 - RNA, 85 nt, Staphylococcus aureus subsp. aureus Mu50
aaaaauaauauauaguauagaaaagcgcuugcuagcaucaucuuuuuaagagguacuagcaagcgcuuuguuauuauuuguuuuu

SEQ ID NO: 4250916 - RNA, 59 nt, Staphylococcus aureus subsp. aureus Mu50
ucccuauacucuuaaugcaucaucacgaauaacguagugauacagauaaaguauaggga

SEQ ID NO: 4250917 - RNA, 76 nt, Staphylococcus aureus subsp. aureus Mu50
ucgcccaauaauuuuaaguuuugaucuucuucaucaucugcauccagaauaucgaauuuuugaauaguuggugcga

SEQ ID NO: 4250918 - RNA, 55 nt, Staphylococcus aureus subsp. aureus Mu50
gcaggcaugagcaaacaaccguacuaugagaauagucuuguuuguucaugccugc

SEQ ID NO: 4250919 - RNA, 105 nt, Staphylococcus aureus subsp. aureus Mu50
uuacguacgacacgaugaucuugaacuucuugugguugauguaagacauaauucuuugcaucuuuuaaucgaccuugagaaaaaagauauuggaauaguauuuga

SEQ ID NO: 4250920 - RNA, 72 nt, Staphylococcus aureus subsp. aureus Mu50
aaugcaaguuggggugggacgacgaaauaaauuuugcgaaaauaucauuucugucccacucccauuggcauu

SEQ ID NO: 4250921 - RNA, 58 nt, Staphylococcus aureus subsp. aureus Mu50
auaaauaaacaccucgcaaaagaaaguaguccuuucuuauggugagguguuuauuugu

SEQ ID NO: 4250922 - RNA, 67 nt, Staphylococcus aureus subsp. aureus Mu50
guaaguggggagugggacagaaaugauauuuucucaaaauuuauuucgucgucccaccccaacuugc

SEQ ID NO: 4250923 - RNA, 56 nt, Staphylococcus aureus subsp. aureus Mu50
gaagaugauuuuuuuaggaaguauauuacaguacuacguauuagaaaaucaucuuu

SEQ ID NO: 4250924 - RNA, 98 nt, Staphylococcus aureus subsp. aureus Mu50
gcugggacauuaaguucuuaggcaauguaaaaaagcugauuucuauuaauuauuugauggaaauuagcuuuuuugauauguauuuuauaauguacagc

SEQ ID NO: 4250925 - RNA, 62 nt, Staphylococcus aureus subsp. aureus Mu50
gcauuguauugacgacauaaguaccagauuucacgugcuuucuuauguccaacgauacgugc

SEQ ID NO: 4250926 - RNA, 111 nt, Staphylococcus aureus subsp. aureus Mu50
guuaacgauuaccuuugggauuaguaagucuuugaugaagaaaauuggguuaucuaguaaaauucccgaugccuuuaaagauuuaccgcauuuuccgaaugaucaguuaau

SEQ ID NO: 4250927 - RNA, 90 nt, Staphylococcus aureus subsp. aureus Mu50
caggaucagcaucuaacuuauucagaccggguacuuuuuguaacaauuuaacuaaguaaauaccuggugcauaagaaaucgugcuuccug

SEQ ID NO: 4250928 - RNA, 65 nt, Staphylococcus aureus subsp. aureus Mu50
gucgagcgcuuucuacaaaugaugacauugaaacagcaugucguccauuccaagaagguagagac

SEQ ID NO: 4250929 - RNA, 92 nt, Staphylococcus aureus subsp. aureus Mu50
aacauuuuaauaugaugaggaaaguagugauagcauaugacuuacaugaaguugugugcuaucgcuauuuuuaguuauaauuccaaaaaguu

SEQ ID NO: 4250930 - RNA, 57 nt, Staphylococcus aureus subsp. aureus Mu50
cuauaaauacaagugcauauggaauuaagcuaucaccguuugaacuuguauuuguag

SEQ ID NO: 4250931 - RNA, 80 nt, Staphylococcus aureus subsp. aureus Mu50
gaauuagaagguaaauuacacggcauggcauuacguguaccaacaaagaauguaucgcucguugauuuaguuguugauuu

SEQ ID NO: 4250932 - RNA, 60 nt, Staphylococcus aureus subsp. aureus Mu50
gaugcgagugaaacgcuaaaggauauuggggccgaugucaauauuggccuucauuccguc

SEQ ID NO: 4250933 - RNA, 93 nt, Staphylococcus aureus subsp. aureus Mu50
agaauugaaacgcucuucauugauuauuuaggugcugaagauaaucacuacaaucgagaaguuacaaagaaauggaugaugggugcaguugcu

SEQ ID NO: 4250934 - RNA, 57 nt, Staphylococcus aureus subsp. aureus Mu50
ggcgcaugccacuaaaaugauugauguuguauuuuaaaucauagugguuuaugcguc

SEQ ID NO: 4250935 - RNA, 65 nt, Staphylococcus aureus subsp. aureus Mu50
acgagccauauguguuagcaguaacugcuuguccaacagguauugcacauacguacauggcacgu

SEQ ID NO: 4250936 - RNA, 56 nt, Staphylococcus aureus subsp. aureus Mu50
aaaagcuucuaaugugauacaggaaccucauauuccguaucauguuagaagcuuuu

SEQ ID NO: 4250937 - RNA, 81 nt, Staphylococcus aureus subsp. aureus Mu50
gcgauuacuaaaugcuacaaacgcuugugcauuauuaucaagauuuaaugaugcuaagaauuuuaguaaguaaagacccgc

SEQ ID NO: 4250938 - RNA, 71 nt, Staphylococcus aureus subsp. aureus Mu50
ggucagcauuguaaugaucugaaauaaagacaacauugccaccuuguuucacauaguuaacaauugcugcc

SEQ ID NO: 4250939 - RNA, 64 nt, Staphylococcus aureus subsp. aureus Mu50
gcuuuauugaugaugucuuuaugcuccgcuucuauuucugccaaccaagcaucaucgauaaugc

SEQ ID NO: 4250940 - RNA, 80 nt, Staphylococcus aureus subsp. aureus Mu50
gcaacuuuagguaaugucauguuugcuucuauuuauuuagcaacagauauuuuaaaugauauuuaugggcguagaguugc

SEQ ID NO: 4250941 - RNA, 56 nt, Staphylococcus aureus subsp. aureus Mu50
ucauuagaaauagcuucaauggcugcagucaaaccugcaacuaucuuuucuaaugg

SEQ ID NO: 4250942 - RNA, 69 nt, Staphylococcus aureus subsp. aureus Mu50
acccucacaacacguuuggcauauauccuuucacgucaaacaggacuuaugcauaaguauugugagggu

SEQ ID NO: 4250943 - RNA, 85 nt, Staphylococcus aureus subsp. aureus Mu50
uaauguuauauaguagggauugggacagaaauguuauuuucacaaaauucauuucguugacccacuuccugcuuuuucuuuauua

SEQ ID NO: 4250944 - RNA, 78 nt, Staphylococcus aureus subsp. aureus Mu50
gguauuggauaugaauaucaagcuguccaacaaggcgcagaugucuuuguuacaggugauauuaaacaucaugaugcc

SEQ ID NO: 4250945 - RNA, 57 nt, Staphylococcus aureus subsp. aureus Mu50
gugcuuugauggauuuuuaauaaaaaacuggaguaguuuuaagugucuaucaagcau

SEQ ID NO: 4250946 - RNA, 108 nt, Staphylococcus aureus subsp. aureus Mu50
gauaaugucauuuuuaauugagcuaaacagacagggaaagacgauuauuaugauuacgcaugauaugcauuuauugucugaguauaguucaagaacaguuguauuauc

SEQ ID NO: 4250947 - RNA, 63 nt, Staphylococcus aureus subsp. aureus Mu50
uagacaccaaaaaacagaggucuucgcaaucauuagcgaaaaccucuguuuuguugguguuua

SEQ ID NO: 4250948 - RNA, 65 nt, Staphylococcus aureus subsp. aureus Mu50
ggcaaaguugacuagaauugaaaaaagcuuguuacaagcgcauuuucguucagucaacuacugcc

SEQ ID NO: 4250949 - RNA, 70 nt, Staphylococcus aureus subsp. aureus Mu50
gauauuacgacugaauacggcgcauugcuaauuuucgaugaaguaaugacugguuucagagucgguuauc

SEQ ID NO: 4250950 - RNA, 68 nt, Staphylococcus aureus subsp. aureus Mu50
uuguguuguuguacgaucaucuuuugaugacuucgaaauuaauaaaugauggucgcucaucgaugcaa

SEQ ID NO: 4250951 - RNA, 100 nt, Staphylococcus aureus subsp. aureus Mu50
uaaauuugcaguugaacuuaauaaagauauuuauacagggcuauuaucuaauauggcuucaaugguauuuuuauuaggugaacucaauguaucagauuua

SEQ ID NO: 4250952 - RNA, 69 nt, Staphylococcus aureus subsp. aureus Mu50
guuaugcaaaguaaugauaugaaucacguuuauguguuaccacaacuucauacauuacuuuggaguaau

SEQ ID NO: 4250953 - RNA, 80 nt, Staphylococcus aureus subsp. aureus Mu50
gaauuaacacguaaaauggcuaaaagcauugaagcacauccaaaugcuacagugcaauuuaaccaugaaguuguugauuu

SEQ ID NO: 4250954 - RNA, 66 nt, Staphylococcus aureus subsp. aureus Mu50
gcauuguaguuuauuugcgagguggcaaaggucaaguaggacgugugcgcgcagguagauuaaugc

SEQ ID NO: 4250955 - RNA, 72 nt, Staphylococcus aureus subsp. aureus Mu50
ucuauuauucgaggaacaccaaugauaguacaacuauuuaucauauuuuaugguauuccagaauuagguaga

SEQ ID NO: 4250956 - RNA, 64 nt, Staphylococcus aureus subsp. aureus Mu50
aucugauggaucuggaucuguaccuccugcccaugaucugaaguacacuuccauaucuuuagau

SEQ ID NO: 4250957 - RNA, 79 nt, Staphylococcus aureus subsp. aureus Mu50
ccaucacgauuugggaggaaauuuuauuggaccuucaagagcgcgguuugaaaaauguccuccuguucaucacggaugg

SEQ ID NO: 4250958 - RNA, 64 nt, Staphylococcus aureus subsp. aureus Mu50
uccaccuaaaauugggaagauaguuguacgacuaucuaugaauaauucucuguuuucagguggg

SEQ ID NO: 4250959 - RNA, 57 nt, Staphylococcus aureus subsp. aureus Mu50
aaaagcaccuuuauucaucauuaauuguuguggucgacgaugaguaaagaugcuuuu

SEQ ID NO: 4250960 - RNA, 82 nt, Staphylococcus aureus subsp. aureus Mu50
uuaaaaaagaauauuguaaugaugcaugcuguaaaugaauaaauucagauuuagcuucaucaauugugaguucuuuauuuga

SEQ ID NO: 4250961 - RNA, 68 nt, Staphylococcus aureus subsp. aureus Mu50
ugaauacacuacuaaagccuuaaugucaugcuacgaauauugugcaugauauuaaggcuuuguauuua

SEQ ID NO: 4250962 - RNA, 73 nt, Staphylococcus aureus subsp. aureus Mu50
aagaaaaaauggauuauauggauguaucgccgaagcaaguuguuucagcagcgacagcauguauuccauucuu

SEQ ID NO: 4250963 - RNA, 65 nt, Staphylococcus aureus subsp. aureus Mu50
ggcaguaguugacugaacgaaaauucgcuuguaacaagcuuuuuucaauucuagucaaccuugcc

SEQ ID NO: 4250964 - RNA, 79 nt, Staphylococcus aureus subsp. aureus Mu50
gcaaucaagugcuacgaaugauugaauuaccguuaucuguuucgguuauuaucgguggcauucguauugccuugguugu

SEQ ID NO: 4250965 - RNA, 80 nt, Staphylococcus aureus subsp. aureus Mu50
guauugaaauuaaaaaagcaccuagcaacucguuaggacaaucacgaugauugucuacaguugcagguggauuugaauau

SEQ ID NO: 4250966 - RNA, 60 nt, Staphylococcus aureus subsp. aureus Mu50
aaggauacggaaucucuuguugcaucucuuuacgagaaauaacagggaauccauauccuu

SEQ ID NO: 4250967 - RNA, 60 nt, Staphylococcus aureus subsp. aureus Mu50
uaucugccguuugauuucagaagaacgucuauaucguuuuauugaucgacacgguaagug

SEQ ID NO: 4250968 - RNA, 80 nt, Staphylococcus aureus subsp. aureus Mu50
uuggucacuaaaucauaaguggauuguaauuauauuaaguacauuaauuuugguugcaacuauuguauuuggaggaccga

SEQ ID NO: 4250969 - RNA, 87 nt, Staphylococcus aureus subsp. aureus Mu50
uugcuauuagcaguuuuacucuuuaaaggauuuaauaaauggagcgguagaacaauuaaagauuaaagauuggggcgcuaaugguaa

SEQ ID NO: 4250970 - RNA, 81 nt, Staphylococcus aureus subsp. aureus Mu50
ugcuuuucuuguucugucguaaugauguaauaaccacguucacuagguuuauaacugcauccgauaggauagccauaauca

SEQ ID NO: 4250971 - RNA, 76 nt, Staphylococcus aureus subsp. aureus Mu50
gccuaauugcaauucaguugaccaugcaugcacuaaauucaacaaauuucguugucguauggcaaccccuuuaggc

SEQ ID NO: 4250972 - RNA, 79 nt, Staphylococcus aureus subsp. aureus Mu50
uaagugcuugugcuucaguuaauuuuugugcuacuucaccacgaguugcugcauuauugauuugauuuucaagugcuug

SEQ ID NO: 4250973 - RNA, 67 nt, Staphylococcus aureus subsp. aureus Mu50
uacaaacaacauccuuucaaaguauuuacaauuagugugaauuacuuugaagggauuguuuuuugug

SEQ ID NO: 4250974 - RNA, 68 nt, Staphylococcus aureus subsp. aureus Mu50
aagcauauggcguucuauuuauagaugcgcaguuugagccguuaagaaaaauggaagcgccuauguuu

SEQ ID NO: 4250975 - RNA, 65 nt, Staphylococcus aureus subsp. aureus Mu50
ggcaagguugacuagaauugaaaaaagcuuguuacaagcgaauuuucguucagucaacuacugcc

SEQ ID NO: 4250976 - RNA, 98 nt, Staphylococcus aureus subsp. aureus Mu50
aaacuuaauuuagaaaaucuugaugcguugaguaaacugauuacuggugaaacuagugguauguuagcagaaugcguaaucuuuuuaaaugaaaguuu

SEQ ID NO: 4250977 - RNA, 68 nt, Staphylococcus aureus subsp. aureus Mu50
uauuaugaacgaaacagacuuacaaggccuauuauuuugguuaaguggcuccguuucauuacguaaua

SEQ ID NO: 4250978 - RNA, 81 nt, Staphylococcus aureus subsp. aureus Mu50
aauaauuugauugauuaugacuucggaauugauuuugcagaaagagcaaucaaaaaugaagacauaguuaauaaaaauguu

SEQ ID NO: 4250979 - RNA, 70 nt, Staphylococcus aureus subsp. aureus Mu50
uacugguacauguggagguacuugagauaaaaacgaaucuaagcucucaugauuaaaauauguaccugua

SEQ ID NO: 4250980 - RNA, 63 nt, Staphylococcus aureus subsp. aureus Mu50
cgucacacgauguacacacuuugaacacauauuuccaaaaugagcauguacaucauugugaug

SEQ ID NO: 4250981 - RNA, 78 nt, Staphylococcus aureus subsp. aureus Mu50
ggugaaagguaugacaacacaguuaaauaucaauucagucauugaaaaugcgaaacguguuauuacaccauuaucacc

SEQ ID NO: 4250982 - RNA, 77 nt, Staphylococcus aureus subsp. aureus Mu50
acuuaguaacuaugauuuuauuaacggucuauggcgcaaucaauggucaaggcggcaguacaauaugguuaauaggu

SEQ ID NO: 4250983 - RNA, 67 nt, Staphylococcus aureus subsp. aureus Mu50
aaaucauggagugggauagaaaugauauguucacaaacuuuauuucguuaucccacucacaugauuu

SEQ ID NO: 4250984 - RNA, 87 nt, Staphylococcus aureus subsp. aureus Mu50
uuuauuuauagaagcuacuuucuugaagacaauucagcguauuauacguggaacauguuugugggaaguagcuuuuuuauaugugaa

SEQ ID NO: 4250985 - RNA, 65 nt, Staphylococcus aureus subsp. aureus Mu50
aaaaacaucgagucagaugcuaguuagugguuucaauaaccaccuuuuucugacucgauguuuuu

SEQ ID NO: 4250986 - RNA, 73 nt, Staphylococcus aureus subsp. aureus Mu50
auuuuuaggcuuuguugcuguaauauuaaccguuuguuuaauugguuuauuaauauuagcaacaaaugaagau

SEQ ID NO: 4250987 - RNA, 86 nt, Staphylococcus aureus subsp. aureus Mu50
uuuauccuaaauuagaaucuuacgguauuaaacaaauugcacaacguacugcuggauuugauauguaugauuuagauuuagcuaaa

SEQ ID NO: 4250988 - RNA, 82 nt, Staphylococcus aureus subsp. aureus Mu50
aauccauccguuauaaacgcauguauuaauaaguuaucguauugcaacgauuacuuucaaacaugggucauacggauggauu

SEQ ID NO: 4250989 - RNA, 99 nt, Staphylococcus aureus subsp. aureus Mu50
aagcuaaaaguauaguuaagauugauaugcucccuauaaauauugcacuuuuuaagugucuacuuuauagggagcauauuugauacuagcuuuugguuu

SEQ ID NO: 4250990 - RNA, 87 nt, Staphylococcus aureus subsp. aureus Mu50
uuuuugagugaggauacagauuaaucguacauauuagacaaaagcaauggugcuuucuaagugaugauguuuguguaaauugagaaa

SEQ ID NO: 4250991 - RNA, 76 nt, Staphylococcus aureus subsp. aureus Mu50
uucacucagguuuaacauuauuacaaaucccugaaggcguugacugggauggcgaaguaguuaaaguuguaguggg

SEQ ID NO: 4250992 - RNA, 80 nt, Staphylococcus aureus subsp. aureus Mu50
agcuuucugaaccagaaacgaaaaaaaucuauagucaaagaaaaauugauguagagcuuguuuuuggauuuaugaaggcu

SEQ ID NO: 4250993 - RNA, 79 nt, Staphylococcus aureus subsp. aureus Mu50
agugaaccauaacuuaaaagucacaauacacaugacuaaaaaugucugugcuauuguggcuuuuuuaaauugguugauu

SEQ ID NO: 4250994 - RNA, 88 nt, Staphylococcus aureus subsp. aureus Mu50
caucaaugucauggacagaaauaugauguaauuguuguucgauuguugaaaaauaaucuauauuaucuuucgucaauugaauuugaug

SEQ ID NO: 4250995 - RNA, 101 nt, Staphylococcus aureus subsp. aureus Mu50
gaagaagacugugguacugauagagguuuauuaguuucugauauuaaagaagguacagaaaugauugaaccauuuaucgaacguauugaaggucguuauuc

SEQ ID NO: 4250996 - RNA, 65 nt, Staphylococcus aureus subsp. aureus Mu50
aauucccuauacuuuaucuguaucacuacguuauucgugaugaugcauuaagaguauagggauuu

SEQ ID NO: 4250997 - RNA, 91 nt, Staphylococcus aureus subsp. aureus Mu50
aaaaaagcguuuuccuaugucauuuaacuaaacauguaaguucguaugaacguuguuuguuaaauagaugauucuaggaaaaugcuuuuuu

SEQ ID NO: 4250998 - RNA, 57 nt, Staphylococcus aureus subsp. aureus Mu50
uagccaauguuuagcauugcuuaaugacagaagucaucucguacuaaauauuggcua

SEQ ID NO: 4250999 - RNA, 61 nt, Staphylococcus aureus subsp. aureus Mu50
ugucggaugugaugauuuaccugaaaguuuauuucgaauaaauuuaauuacauaaccgaca

SEQ ID NO: 4251000 - RNA, 86 nt, Staphylococcus aureus subsp. aureus Mu50
gguucuguuuacaaucgugauaauguugaacucguuguuaugcaaacaacagcuggugagauaggugucaugaguggacauauucc

SEQ ID NO: 4251001 - RNA, 64 nt, Staphylococcus aureus subsp. aureus Mu50
ucaaacuuucuaaacuuucaucaaguggcugguuaagcaauugauauaguucagaaauguuugg

SEQ ID NO: 4251002 - RNA, 77 nt, Staphylococcus aureus subsp. aureus Mu50
ucugcugguggauacuguugauuaacauccgacugauuacuugacucauucguuuuaucguuaguauuaccauuaga

SEQ ID NO: 4251003 - RNA, 65 nt, Staphylococcus aureus subsp. aureus Mu50
acaauugacccaguuacgauuucaugcaagaugauauuugacaugaaaacguaauuggguuuugu

SEQ ID NO: 4251004 - RNA, 87 nt, Staphylococcus aureus subsp. aureus Mu50
uguagguaaaguuacaggugguaaaacuuguauguauggaggaauaacaaaacaugaaggaaaccacuuugauaaugggaacuuaca

SEQ ID NO: 4251005 - RNA, 80 nt, Staphylococcus aureus subsp. aureus Mu50
ucauaccuauuuaugguaaagcugaaaguuuaaauguagcgauugcagguaguauuuuacuuuaucauuugaaagguuga

SEQ ID NO: 4251006 - RNA, 56 nt, Staphylococcus aureus subsp. aureus Mu50
guaucauuuaagcugaaacgcggacaaauaguuggucucguuggagcgaauggugc

SEQ ID NO: 4251007 - RNA, 61 nt, Staphylococcus aureus subsp. aureus Mu50
aacagauaucauugccgcugaagguaaaaucgucacugcuggugguauugauacucauguu

SEQ ID NO: 4251008 - RNA, 89 nt, Staphylococcus aureus subsp. aureus Mu50
acauuuauugagagcgggacggaaaugauaaagaacgacuaaugauugauuauguagcgauucuuuaucauuagucaaagcuaaugugu

SEQ ID NO: 4251009 - RNA, 66 nt, Staphylococcus aureus subsp. aureus Mu50
uggauaaauugaaaucugguugaagucguuacuaucauagcgaccuuuagccagauuuuuugugca

SEQ ID NO: 4251010 - RNA, 76 nt, Staphylococcus aureus subsp. aureus Mu50
uggauuaucuugguuugguguagucacaauuucuaacuggccauuguuuacgacuaaccaagcccaaccugaacca

SEQ ID NO: 4251011 - RNA, 74 nt, Staphylococcus aureus subsp. aureus Mu50
gcuuggaauucaucuaaauccauuuguugacccgcaucacuaagugcaacagauggaucuggaugcaccucagc

SEQ ID NO: 4251012 - RNA, 55 nt, Staphylococcus aureus subsp. aureus Mu50
auuauggacaaauauuccauuggcauucuuaaaauccuuggaaauuguucauggu

SEQ ID NO: 4251013 - RNA, 72 nt, Staphylococcus aureus subsp. aureus Mu50
aaccaaaaauguuguuauaucggagcgugauuauaaaaacuuagugacugcugcgagagauaacgauagguu

SEQ ID NO: 4251014 - RNA, 107 nt, Staphylococcus aureus subsp. aureus Mu50
gugauuuaauggaagguauaucgcaugaagcagcuucauuugcuggacauaauaaauuaaguaaauuaguuguuuuauacgauucaaaugauauuucauuagauggc

SEQ ID NO: 4251015 - RNA, 103 nt, Staphylococcus aureus subsp. aureus Mu50
gagccucuuuaccuugaaaaguaugaacaguaccaauggauuuaucgacccauugauuaauuuuuguacguucaauaucaauucuagucgguaguuguugcuu

SEQ ID NO: 4251016 - RNA, 74 nt, Staphylococcus aureus subsp. aureus Mu50
uacuaauuuaaguuugguguuucacuauaauguuguguauaauaaacaacguuuacuaccaaacuuguguggug

SEQ ID NO: 4251017 - RNA, 80 nt, Staphylococcus aureus subsp. aureus Mu50
gcuauaaucaaaucaaaacugacuaguacacgaggcauauucuacuaugcuugcgaacuagucaguuuuaguuuuauggu

SEQ ID NO: 4251018 - RNA, 104 nt, Staphylococcus aureus subsp. aureus Mu50
cuaaucacagcacuaccuaaucgaacuaaauuauugggcguagguuuauggcuuguaccuaaaccaguccguaauuucgguuaucgaauguuugcuaauaauag

SEQ ID NO: 4251019 - RNA, 69 nt, Staphylococcus aureus subsp. aureus Mu50
uuggcaguaguugacugaacgaaaaugcgcuuguaacaagcuuuuuucaauucuagucaaccuugccgg

SEQ ID NO: 4251020 - RNA, 55 nt, Staphylococcus aureus subsp. aureus Mu50
ucguaaucguauaaaguuuuaacuguaggaauagcuaaagcagcaacgauuauga

SEQ ID NO: 4251021 - RNA, 55 nt, Staphylococcus aureus subsp. aureus Mu50
gugugggauugcauuguucacuauugauuuccuaggaacaaaaccaguugcacau

SEQ ID NO: 4251022 - RNA, 69 nt, Staphylococcus aureus subsp. aureus Mu50
auucagaccgaaaagaaagcauaugcaacuucaagagugaaggggcauaugcuucuuuuucaauugagu

SEQ ID NO: 4251023 - RNA, 56 nt, Staphylococcus aureus subsp. aureus Mu50
caaaguaauguaugaaguugugguaacacauaaacgugauucauaucauuacuuug

SEQ ID NO: 4251024 - RNA, 130 nt, Staphylococcus aureus subsp. aureus Mu50
aaggacguauuacauuugagucaccaaugcuauucucauuagcauuuaucccuaacuuccuuuuaggugguguuacggguguaauguuagcaauggcaucagcugacuaucaauaucacaauacguacuu

SEQ ID NO: 4251025 - RNA, 61 nt, Staphylococcus aureus subsp. aureus Mu50
augcuuauaucaaaguagcuggcgguguaaaguuaacggagccagcaguugauuuaagugu

SEQ ID NO: 4251026 - RNA, 73 nt, Staphylococcus aureus subsp. aureus Mu50
aaaagauaguuauuuaugugaaugggugaauagggaagaaaauguucuuuuauuacguaaauacuaugcuuuu

SEQ ID NO: 4251027 - RNA, 67 nt, Staphylococcus aureus subsp. aureus Mu50
aacuucagguggucuucacgguguuggugcuucaguuguaaaugcauugagugaauggcuugaaguu

SEQ ID NO: 4251028 - RNA, 84 nt, Staphylococcus aureus subsp. aureus Mu50
aaagaaaauguuggacauuacucgauuuuuagaaacuggauguucuucuuccaaagagugagugguaucuuaacauuuaucuuu

SEQ ID NO: 4251029 - RNA, 81 nt, Staphylococcus aureus subsp. aureus Mu50
guaucauuuuuggauaauuguguuacaagaauugcuuaaacuuaucuugcaauuuuucacgucaauugaccuuuaugcuac

SEQ ID NO: 4251030 - RNA, 55 nt, Staphylococcus aureus subsp. aureus Mu50
aacaaacaccccuaauauuguuaucaucagcuaaacaauguuagggguguuuguu

SEQ ID NO: 4251031 - RNA, 68 nt, Staphylococcus aureus subsp. aureus Mu50
uuguaauuggaggacaaauaaugguuauggcagauuuuauugguagccauauacugucaccaguacaa

SEQ ID NO: 4251032 - RNA, 113 nt, Staphylococcus aureus subsp. aureus Mu50
uguuauuguuuuggcgugucucccgauaagcguuguaugaggcaaugauuguuguaauucauaggcaauaguuguaccgacagcgccugggccgauaaucgcaacugauaaca

SEQ ID NO: 4251033 - RNA, 113 nt, Staphylococcus aureus subsp. aureus Mu50
augugucaauaauacguucgacuugggcaucgcuuaaaugguuuugauuuuuuccuuuuucaaaaucauuggaugcaucgauaaauaauacguugucgucuuguuggcaacau

SEQ ID NO: 4251034 - RNA, 78 nt, Staphylococcus aureus subsp. aureus Mu50
gcgacuagguaacaaugucaaagaacguacugcuuuaaucucuaaagucaugguuaaucuugacgacuuaccauucgu

SEQ ID NO: 4251035 - RNA, 57 nt, Staphylococcus aureus subsp. aureus Mu50
aaacacgcggugggcgaaaucaguuugaauugacugacuucguuuuaccgcguguuu

SEQ ID NO: 4251036 - RNA, 89 nt, Staphylococcus aureus subsp. aureus Mu50
cacauaaaaauuuaucaucaacaauuggugaaccuaaugccaaugcauaugcuucgggcugguuuaccaauaaugaugaacauuuagug

SEQ ID NO: 4251037 - RNA, 63 nt, Staphylococcus aureus subsp. aureus Mu50
gcaagguugacuagaauugaaaaaagcuuguuacaagcgcauuuucguucagucaacuacugc

SEQ ID NO: 4251038 - RNA, 77 nt, Staphylococcus aureus subsp. aureus Mu50
uguguuggggccccugacuagaauugaaaaaagcuuguuacaagcgcauuuucguucagucaacuacugccaauaua

SEQ ID NO: 4251039 - RNA, 108 nt, Staphylococcus aureus subsp. aureus Mu50
uauuugcaaaucugcacuuauuaacgugaaaugcuuggauugauggcacaauuccuucuaucguuucaagucguuucugcccuucuuuaaguuuuggaauuguugaua

SEQ ID NO: 4251040 - RNA, 98 nt, Staphylococcus aureus subsp. aureus Mu50
ggucaugaugcuuccauguuuguuccguuguuaaaaugauaauuaaaaugaugguuaaaaugauuagcaauguuucagcaauauagaacguaucggcc

SEQ ID NO: 4251041 - RNA, 69 nt, Staphylococcus aureus subsp. aureus Mu50
cauuaguacggacuguuguaugaugaucgucagaugacaauucagucguuucaacauuuguaugcaaug

SEQ ID NO: 4251042 - RNA, 69 nt, Staphylococcus aureus subsp. aureus Mu50
agaaacgagagauuuguucgaacauguacaauugaaggauuguuuaugugggacaagucucucguuuuu

SEQ ID NO: 4251043 - RNA, 63 nt, Staphylococcus aureus subsp. aureus Mu50
auaaaagaacugcuagcugaaauguuaugagauauucauaacuacggcuagcaguuuuuuuau

SEQ ID NO: 4251044 - RNA, 130 nt, Staphylococcus aureus subsp. aureus Mu50
gagcccguaacgucucaucaccaugugugucuaacgaauugucuuuuguugcguauacuacuuuugcuaucuuacaaucaauaauuuuguuaacacagggugguguugaaccaaaaugacuacauggcuc

SEQ ID NO: 4251045 - RNA, 57 nt, Staphylococcus aureus subsp. aureus Mu50
ugaaagcgccccaucaaauaaacacuaacacaguguaaaguugaaggggcgcuuuca

SEQ ID NO: 4251046 - RNA, 76 nt, Staphylococcus aureus subsp. aureus Mu50
gucaccaaaauguuuaauacaauauggaguugaaaaauaaggcuccuuaguaacauuguauucaauauuugcugau

SEQ ID NO: 4251047 - RNA, 80 nt, Staphylococcus aureus subsp. aureus Mu50
aaaucgcauaaauaauugaugugaagcggacaaucuuaauuuaguuuaagguuguccuuuuucauuuaauugagugauuu

SEQ ID NO: 4251048 - RNA, 73 nt, Staphylococcus aureus subsp. aureus Mu50
uuugaaccguuugaugaacaagcauaucaauuguuuggugauguaucgguggcuuauucagcaacaguucgaa

SEQ ID NO: 4251049 - RNA, 70 nt, Staphylococcus aureus subsp. aureus Mu50
uuauucgauauaacacaucaaacacaaaaaccaaagacgguggacgugagggguguguuauuuuugauga

SEQ ID NO: 4251050 - RNA, 129 nt, Staphylococcus aureus subsp. aureus Mu50
uuaaaaaugucauguaggugcuauaauaguuuugcaauuugcaaauuuuacugaaaccgguuuuaaacgaauugaauuuaaagcaugguuuugguaaaguuaauguauaaaacuaaguuaguauuguaa

SEQ ID NO: 4251051 - RNA, 59 nt, Staphylococcus aureus subsp. aureus Mu50
uuugaauuacguugucgcguccuugggauugcaauccaagaacgucagcauaaucuaaa

SEQ ID NO: 4251052 - RNA, 80 nt, Staphylococcus aureus subsp. aureus Mu50
uugaaaguguugaaaagcacuaugauaaugguauugaacuugaauuuaauacacuuuaucagguguuacgcacuuuacaa

SEQ ID NO: 4251053 - RNA, 65 nt, Staphylococcus aureus subsp. aureus Mu50
ugugaauaagcucccuucaaaguagacauugaaaaaugaaaauuuugaagggagccuuauuuaug

SEQ ID NO: 4251054 - RNA, 65 nt, Staphylococcus aureus subsp. aureus Mu50
auggcuaaaaagauuaacgcgaagaugagaugguaauugucuuuuuuauuaaucuuuucggucau

SEQ ID NO: 4251055 - RNA, 113 nt, Staphylococcus aureus subsp. aureus Mu50
auugaauguguuauaugaucguuaucaguuaccacuuuuuauuguggaaaaugguuuuggugcaguugaugaagugguagauggacauauucaugaugauuaucgcauugaau

SEQ ID NO: 4251056 - RNA, 65 nt, Staphylococcus aureus subsp. aureus Mu50
aaagacagauuguagguggaauauucgaacauaacaguucaauucauccuuaacaaucugucuuu

SEQ ID NO: 4251057 - RNA, 77 nt, Staphylococcus aureus subsp. aureus Mu50
gcuuggugucuucuuagcgguuuaugugaugauuuuaaucuauuuugaaauacuaacauugacuucucaccguuggc

SEQ ID NO: 4251058 - RNA, 59 nt, Staphylococcus aureus subsp. aureus Mu50
uguggagcaaguagaugcgguuguuggagcaacugauacgauugcauuagcugccuaua

SEQ ID NO: 4251059 - RNA, 63 nt, Staphylococcus aureus subsp. aureus Mu50
aucgauacuguauacucuggagauaucgcggcugcgguaggucuuaaagauacagguacuggu

SEQ ID NO: 4251060 - RNA, 57 nt, Staphylococcus aureus subsp. aureus Mu50
ugaaagcgccccuucaacuuuacacuguguuaguguuuauuugauggggcgcuuuca

SEQ ID NO: 4251061 - RNA, 107 nt, Staphylococcus aureus subsp. aureus Mu50
ggguauaacacauaccucaacuuagcuaaacaacguuuuaaaugcuuagaaugcaauggcacuuuuacugcuaaaacgucaauuguugaugagucguguuuuaucuc

SEQ ID NO: 4251062 - RNA, 58 nt, Staphylococcus aureus subsp. aureus Mu50
gggcaucuuucacuuucuucuuauuuucgucaguauuuaaagugguuuuaggaugccu

SEQ ID NO: 4251063 - RNA, 72 nt, Staphylococcus aureus subsp. aureus Mu50
uucauauugaguucauauuucaaccuuauacugacgcuaaagaagaaauagggagaagugaaucgauaugaa

SEQ ID NO: 4251064 - RNA, 61 nt, Staphylococcus aureus subsp. aureus Mu50
ucaucgacaaguuuagauugccauauuuacuugggaaggcagacuacaucuuuguugauga

SEQ ID NO: 4251065 - RNA, 114 nt, Staphylococcus aureus subsp. aureus Mu50
aauauauuugaggauaauacaauggucuuucuagcgauaucacuacuauucauuuuaggguuauguauaggugucgguaugauauugcgugaauucuauaucuuuagguuuauu

SEQ ID NO: 4251066 - RNA, 64 nt, Staphylococcus aureus subsp. aureus Mu50
ugcaguuagaaagaaagccacugaacguaucgcacgaucagugaacuuuccucuuuuuaaugca

SEQ ID NO: 4251067 - RNA, 91 nt, Staphylococcus aureus subsp. aureus Mu50
cuauagaauguggugccgauuuaauagcaggaucauuaauuaaaaacccuggcggugguuuagcuaagauugguggauacauugcugguag

SEQ ID NO: 4251068 - RNA, 130 nt, Staphylococcus aureus subsp. aureus Mu50
aagagguuauaauuauauggaauccaugggauaaugguuuuaugacucaagaugcuaaaaacaauguuauuccaguauccaauggcgaccauuaucgaugguauucaucuauuuaugguuauuaaaauuu

SEQ ID NO: 4251069 - RNA, 100 nt, Staphylococcus aureus subsp. aureus Mu50
gugacagggguuauuggaagucuuuuuguguauauuauauuguugcaaauggcacaauuuuauucacaacaagcauauggcuuauggccucaaguguggc

SEQ ID NO: 4251070 - RNA, 58 nt, Staphylococcus aureus subsp. aureus Mu50
gucaacaaguagaugccaauuggcaaacuuauauuaugauugccgucuacuucuugau

SEQ ID NO: 4251071 - RNA, 67 nt, Staphylococcus aureus subsp. aureus Mu50
gaauuagcuuuuucacauaucauaggucugaugcagacauugaaauuguugaagaagacuuugauuu

SEQ ID NO: 4251072 - RNA, 68 nt, Staphylococcus aureus subsp. aureus Mu50
acccuaaauuuauuucugcagcaaguguugaucaaccaaucaauucugauagcguagaaaucucgggu

SEQ ID NO: 4251073 - RNA, 71 nt, Staphylococcus aureus subsp. aureus Mu50
aacucaggaugcuaugagagaauuuuauccacauuugaauacagggaugucauuuauucgugguguugguu

SEQ ID NO: 4251074 - RNA, 106 nt, Staphylococcus aureus subsp. aureus Mu50
aucaauugguuugcuuguuggcuaauauauugaccauauuguauauugucaccuucuacagaugcauacguguuuaguuugucuucauaagcuuuguuuaauugau

SEQ ID NO: 4251075 - RNA, 83 nt, Staphylococcus aureus subsp. aureus Mu50
uacaaaguaaccaaauugauauuguugccaaugguuuugccauuuuucaauccaccguugugugucuaauuuggaauuaugua

SEQ ID NO: 4251076 - RNA, 64 nt, Staphylococcus aureus subsp. aureus Mu50
augaauuuacuccuuacaauaaagacauauagcggugucaauauuguagggaguauuguuuuau

SEQ ID NO: 4251077 - RNA, 90 nt, Staphylococcus aureus subsp. aureus Mu50
gcacuuaaagaagguaagaucgauauugaaaguguguuagaugggguuucugagcgcaccaaaguaauagcgauucaacguucgaaaggc

SEQ ID NO: 4251078 - RNA, 60 nt, Staphylococcus aureus subsp. aureus Mu50
aaggauauggauucccuguuauuucucguaaagagaugcaacaagagauuccguauccuu

SEQ ID NO: 4251079 - RNA, 69 nt, Staphylococcus aureus subsp. aureus Mu50
uuccuauaacagaaguugauaauuauccuaaaaaugaagugauaauuauagcuacugguaugcaaggag

SEQ ID NO: 4251080 - RNA, 58 nt, Staphylococcus aureus subsp. aureus Mu50
gaaccuuuuucacuugguuaugaggguuaacuaucuuuaguucuugggaugaagguuc

SEQ ID NO: 4251081 - RNA, 65 nt, Staphylococcus aureus subsp. aureus Mu50
ggugcauccagauccaucuguugcacuuagugaugcgggucaacaaauggauuuagaugaauucc

SEQ ID NO: 4251082 - RNA, 85 nt, Staphylococcus aureus subsp. aureus Mu50
uaacuaaaaauuuaucaauguauagccgauuugacaugccuaaauuugggugugucaauggcuguauguuguuuauucuuuauua

SEQ ID NO: 4251083 - RNA, 75 nt, Staphylococcus aureus subsp. aureus Mu50
ucgccuucuuuuggugguaaugagaucauugcauuugguugcaauacaucuuuaccaucauagaaauucacgcga

SEQ ID NO: 4251084 - RNA, 56 nt, Staphylococcus aureus subsp. aureus Mu50
aaucaguauuuccaauuuagcugguguaccaucaguuguauuuggguuauuagguu

SEQ ID NO: 4251085 - RNA, 59 nt, Staphylococcus aureus subsp. aureus Mu50
agaguggcguaacguauguggcguuaacgucuuuuuaauguuugccuuuacgccauuuu

SEQ ID NO: 4251086 - RNA, 76 nt, Staphylococcus aureus subsp. aureus Mu50
uguauugguauuguauuauggguuauaggcuugcauccauuugcagucuucuuuccuauaaucgcuuuacuaauca

SEQ ID NO: 4251087 - RNA, 118 nt, Staphylococcus aureus subsp. aureus Mu50
ugucgcaaacuuuucuuucaauaucguugauagugguauugaaucugcuguagcaaaagaaaucgauguuaaauugguagaugaugcuauuacgagaauuuuaaaagauaacgcgaca

SEQ ID NO: 4251088 - RNA, 73 nt, Staphylococcus aureus subsp. aureus Mu50
cauauuaauaaagcacucauuauuuaaggcgcaucauuacgugggucauugaaaugaugaguguuuuuuugug

SEQ ID NO: 4251089 - RNA, 62 nt, Staphylococcus aureus subsp. aureus Mu50
uaaugaaaaaaugccaagaagcaauggaaguaauccaaugucuucuuggcauuuugaauuua

SEQ ID NO: 4251090 - RNA, 96 nt, Staphylococcus aureus subsp. aureus Mu50
uuuucaagaaggcauucagcuagaaguugaugagccauuuucucuaguuucaaaaaaaugucaugaaaguuuagcuuugaagcacuucauugaaaa

SEQ ID NO: 4251091 - RNA, 79 nt, Staphylococcus aureus subsp. aureus Mu50
gcgaauucgaugaauucagacaucaucguggcgcaacauccuaucauccaaaaaugauguuaaaaaucaucuuauaugc

SEQ ID NO: 4251092 - RNA, 128 nt, Staphylococcus aureus subsp. aureus Mu50
auuaauuagauagaaugaucuguaaauagaauaacgaauagaacuaauagcccguaaauagaaggugauaacacuuuguauuuaugggcuauuuuauuuaaugccugauuugauuuuuauaaauuaau

SEQ ID NO: 4251093 - RNA, 69 nt, Staphylococcus aureus subsp. aureus Mu50
cgccaaaaaugaugguucaauuugcuucugaagcgagagaaagagguauaaacauuaucauugcaggcg

SEQ ID NO: 4251094 - RNA, 82 nt, Staphylococcus aureus subsp. aureus Mu50
aacauucccuuaauaauaaguauggucgugagccccucccaagcucgcggccuuuuuuauuguaauaaagaaggggagaguu

SEQ ID NO: 4251095 - RNA, 69 nt, Staphylococcus aureus subsp. aureus Mu50
auggugaaauaaaugaacaaacuuuuacaagaaucucugauuaauagugaagucauuuguuucaagcau

SEQ ID NO: 4251096 - RNA, 64 nt, Staphylococcus aureus subsp. aureus Mu50
aaaagagcaagguuaacgagucagaaaaucuuuuucuugauacguauaugacacuugcucuuuu

SEQ ID NO: 4251097 - RNA, 115 nt, Staphylococcus aureus subsp. aureus Mu50
ggguugcuugacugcgacuaguucagaugccaauagauuugauuuuugugguucuaaaaauaaucacaaaucauggucgcuauuguugcaguaauuaguugcucuuuggcaaccu

SEQ ID NO: 4251098 - RNA, 87 nt, Staphylococcus aureus subsp. aureus Mu50
uuggaauagcaauuucuugguaagcaguguaugacguucuuaauuuuucaauuagaagcgcaccuacuauugcgaauaagauuccaa

SEQ ID NO: 4251099 - RNA, 57 nt, Staphylococcus aureus subsp. aureus Mu50
acuuaaaaaagcagugaaucauuucaauagauggaaugauuuuacugcuuuuugugu

SEQ ID NO: 4251100 - RNA, 79 nt, Staphylococcus aureus subsp. aureus Mu50
ugguacaaaauaaauguuaauagcgucaguaguauuuccuguauuuugauuuaaauguucaacauauuguuuuggacca

SEQ ID NO: 4251101 - RNA, 66 nt, Staphylococcus aureus subsp. aureus Mu50
aaauaauuaaaauccaagugcuaagagguauacaguuaugccugaagcgcuuggauuuuuugguuu

SEQ ID NO: 4251102 - RNA, 61 nt, Staphylococcus aureus subsp. aureus Mu50
ugauuauaacuauuucuaagucuucgcauuauuugcgaugaugugggaauaguuauuuuua

SEQ ID NO: 4251103 - RNA, 71 nt, Staphylococcus aureus subsp. aureus Mu50
ugauauaaacaugaguacccagaaucgguuuaccaauaggaauacgauuuggaacuuuguuagguauauua

SEQ ID NO: 4251104 - RNA, 58 nt, Staphylococcus aureus subsp. aureus Mu50
ggagauauugguaaagcuuuugcaagaagguugcaaggguuuaauacuaauauucuuu

SEQ ID NO: 4251105 - RNA, 117 nt, Staphylococcus aureus subsp. aureus Mu50
ugauaaauuaaagcuagaaacaaugcgaagaaaucaucgaacaugaaugauauugauuugauucauuacauguuacugaugaacauaccugcauauguguuucuagcuuguuuguua

SEQ ID NO: 4251106 - RNA, 77 nt, Staphylococcus aureus subsp. aureus Mu50
aaaacgcuuuauuauuuugagugcaacuguuaauuauccuguauguauagugauuaauaguguacaucaaguguuuu

SEQ ID NO: 4251107 - RNA, 73 nt, Staphylococcus aureus subsp. aureus Mu50
auguaguuuuagacacgguaacauuauaugucaaguaagugacuauagaauguauggugucaaugacagacau

SEQ ID NO: 4251108 - RNA, 61 nt, Staphylococcus aureus subsp. aureus Mu50
accaauuuguuucuuuguauuacgccaauucauacgguauucauagaagaaguagauuggu

SEQ ID NO: 4251109 - RNA, 58 nt, Staphylococcus aureus subsp. aureus Mu50
ucuugaauaugaaguuagguagcauuuuguuaccuagcuuuuuuauuauauucauaga

SEQ ID NO: 4251110 - RNA, 77 nt, Staphylococcus aureus subsp. aureus Mu50
gcugguauggcucgugaugguaaaacuguacuuuaugauggacguacaggugaaccauucgauaaccguauuucagu

SEQ ID NO: 4251111 - RNA, 82 nt, Staphylococcus aureus subsp. aureus Mu50
uguauauugaaugucauguuaaauaaaguuauauuuuacuaaaugaaauauaaaauuguuugaggugauuucucgguguaua

SEQ ID NO: 4251112 - RNA, 55 nt, Staphylococcus aureus subsp. aureus Mu50
aaaugcucccuucaaaguagacauugaauaaaugaaggcuuugaagggagcauuu

SEQ ID NO: 4251113 - RNA, 74 nt, Staphylococcus aureus subsp. aureus Mu50
ccaacguaggaaaguaguuauugaagugauggggcuaguauagcaacauugccaucaaacuacuuucauguugg

SEQ ID NO: 4251114 - RNA, 63 nt, Staphylococcus aureus subsp. aureus Mu50
aaugucaugcaaaauauauacguauccguaaaguugauacgaaucguaugcguugcggacauu

SEQ ID NO: 4251115 - RNA, 59 nt, Staphylococcus aureus subsp. aureus Mu50
aacuuaguuaaagcgcgcacucaaaguaagaaaauauugagucgugauuugauuauguu

SEQ ID NO: 4251116 - RNA, 73 nt, Staphylococcus aureus subsp. aureus Mu50
ugauugcacuuguaaaugguagaccgaagcuuauuaauuuaaaagaagcguugguacauuauuuagagcauca

SEQ ID NO: 4251117 - RNA, 81 nt, Staphylococcus aureus subsp. aureus Mu50
gcguaccaaagaugucggaguuaucaucaaccauuuguaccaaauccaaacguugugcaauaucuuuagacacuggugcgc

SEQ ID NO: 4251118 - RNA, 65 nt, Staphylococcus aureus subsp. aureus Mu50
cgauuauuauguacguacuugggcuuguagaugauaucuacgauuugaaaccguauauaaaauug

SEQ ID NO: 4251119 - RNA, 57 nt, Staphylococcus aureus subsp. aureus Mu50
aaaaaucgaacugaugagauaauuuggauuguugggauucucaucaguucgauuuuu

SEQ ID NO: 4251120 - RNA, 68 nt, Staphylococcus aureus subsp. aureus Mu50
caauugacauuacgacagcacuuguuguaucaaauguaacgacacgaucugcuguuguaggucccuug

SEQ ID NO: 4251121 - RNA, 109 nt, Staphylococcus aureus subsp. aureus Mu50
aauauuaacaauguuugaugaugaggaguauuuguuccauguguugcguaauggugcgaaagguuacauauugaaaaaugcaccugaugaacaauuauuguuagcuauu

SEQ ID NO: 4251122 - RNA, 66 nt, Staphylococcus aureus subsp. aureus Mu50
aaaugagcgaaugacaaggauugauuacgaaucaaguaaaucaauuguucuaucauucgcuuuuuu

SEQ ID NO: 4251123 - RNA, 67 nt, Staphylococcus aureus subsp. aureus Mu50
aaagucauaugguugaacuuauaagagaugaauauaucaucuuucgauaagauaaccauaugacuuu

SEQ ID NO: 4251124 - RNA, 59 nt, Staphylococcus aureus subsp. aureus Mu50
agaguuggguaguagauaugucagagugaccuaacaucucuugcacugcucuuaaaucu

SEQ ID NO: 4251125 - RNA, 99 nt, Staphylococcus aureus subsp. aureus Mu50
augcugaagucaauucgggucccaauguaugaaaauauguauccggauuauguucggauucaaauugauucauauaaacggcaccauauuuuucagcau

SEQ ID NO: 4251126 - RNA, 74 nt, Staphylococcus aureus subsp. aureus Mu50
aucaauauaaagauugauguaguguugcgggauauuguagugauguucaaguaacauaucaguaacaaguugau

SEQ ID NO: 4251127 - RNA, 110 nt, Staphylococcus aureus subsp. aureus Mu50
caaaaauggauggcggugcaauguuugguguuguuccgaagccguuguggucaaagcaauacaaugcaaaugaacgaaaucaaaucaauuuaccgacacauccaauuuug

SEQ ID NO: 4251128 - RNA, 70 nt, Staphylococcus aureus subsp. aureus Mu50
aacaacuucaugguuaaauugcacuguagcauuuggaugugcuucaaugcuuuuagccauuuuacguguu

SEQ ID NO: 4251129 - RNA, 96 nt, Staphylococcus aureus subsp. aureus Mu50
gggauugcuugcaggaggcucauuauuagucgauuacauacugacugucgcuguuaguauaucaucuggugcugaugcauuuguugcugcauuccc

SEQ ID NO: 4251130 - RNA, 56 nt, Staphylococcus aureus subsp. aureus Mu50
cauuccguuuagaaaaugaauugaaaguuuuuccgagucauuuuucuaaggggaug

SEQ ID NO: 4251131 - RNA, 80 nt, Staphylococcus aureus subsp. aureus Mu50
accuguccgaagaugaagcaaguuccagcaaaauggaagaaacgauuccaggaaccuuugauuuuauuaauggucauggu

SEQ ID NO: 4251132 - RNA, 87 nt, Staphylococcus aureus subsp. aureus Mu50
gaaauaaugcagagguucaacuaggugcugauaaagcugcuaucuuugaugcacauuuauuaguuuuagaugacccugaauuaauuc

SEQ ID NO: 4251133 - RNA, 69 nt, Staphylococcus aureus subsp. aureus Mu50
gaugaacauugggaugaagcaaugaaagauuguaaauaugucuugaguguagcaucuccgguguuuuuc

SEQ ID NO: 4251134 - RNA, 71 nt, Staphylococcus aureus subsp. aureus Mu50
acggauuguuaacuguggauauucuucuggauguuccauugcaucuauuaauguuucacgguuaaauacgu

SEQ ID NO: 4251135 - RNA, 83 nt, Staphylococcus aureus subsp. aureus Mu50
gggagaaucuaaucaagauauuguugauauggcauuugcuuuaaaagaaauggaugccgacaguauuccgauuaauuuuuugc

SEQ ID NO: 4251136 - RNA, 82 nt, Staphylococcus aureus subsp. aureus Mu50
aaguuauauaaaaguagucagaaggagugguguuauuaucauuauaauaaucuagugcuuuauugauuucuuuuauuaauuu

SEQ ID NO: 4251137 - RNA, 62 nt, Staphylococcus aureus subsp. aureus Mu50
aaaagcuacuaacaauggguggugaguuuaauuaaaacuucacuucaaaguuaguagcuuuu

SEQ ID NO: 4251138 - RNA, 128 nt, Staphylococcus aureus subsp. aureus Mu50
uaaaacucaaggguauaacacauaccucaacuuagcuaaacaacguuuuaaaugcuuagaaugcaauggcacuuuuacugcuaaaacgucaauuguugaugagucguguuuuaucucaagauguguua

SEQ ID NO: 4251139 - RNA, 106 nt, Staphylococcus aureus subsp. aureus Mu50
aucuucugguucuuuaccuaaugauuuugguacgauacugaauguauuugaaauaccaucuuuacagcaaucguaagggaucuuagcuacagaacuuaaugaagau

SEQ ID NO: 4251140 - RNA, 61 nt, Staphylococcus aureus subsp. aureus Mu50
ugaggcuaaaguccaaaaacgcacuaaaaacuuaggcgguuuugcaugauuauagcgcuca

SEQ ID NO: 4251141 - RNA, 107 nt, Staphylococcus aureus subsp. aureus Mu50
aaucaccggugcaaaguauuauuuguuauuuagcuuugcaucguuuacauaaagugccuaugaugauggaagguaaauggcaaaguacuauacaucgucaauugauu

SEQ ID NO: 4251142 - RNA, 62 nt, Staphylococcus aureus subsp. aureus Mu50
uaugaucauagguuuauuuaguggcuuuuucuauagagagcuaacaaaagcauaugauuuua

SEQ ID NO: 4251143 - RNA, 75 nt, Staphylococcus aureus subsp. aureus Mu50
uagugugaaguuaaugcagcauuaucauuugauucgaaaguaucuuugucccaauguuuuguuaacuuggcggua

SEQ ID NO: 4251144 - RNA, 69 nt, Staphylococcus aureus subsp. aureus Mu50
cuaaggaauuccuuaaggaacguacagacggcuuaaaagccuuuaaaaacguuuuuaagggguuuguag

SEQ ID NO: 4251145 - RNA, 85 nt, Staphylococcus aureus subsp. aureus Mu50
ugaugggaaagacuuaucgcaagaugcucaugcaaaagauuuagaaucuauggguauuucuguuguaaguggaagucauccauua

SEQ ID NO: 4251146 - RNA, 61 nt, Staphylococcus aureus subsp. aureus Mu50
uugcaaggucguuuuccgauuagaguugaacuugauaguuuaucgguagaagauuuuguaa

SEQ ID NO: 4251147 - RNA, 56 nt, Staphylococcus aureus subsp. aureus Mu50
aaugcgauugcgccuaugauuguacguuuuucauuaaauauaggugugguuguauu

SEQ ID NO: 4251148 - RNA, 55 nt, Staphylococcus aureus subsp. aureus Mu50
gcaggcaugaacaaacaagacuauucucauaguacgguuguuugcucaugccugc

SEQ ID NO: 4251149 - RNA, 117 nt, Staphylococcus aureus subsp. aureus Mu50
aauauuaucgggaauuuauuagguaauacgauuaucguugaucauuuaaagcaugcaaaugaauuggcacgugcgauuaaauaucgaacucguauuguuacuuuggaaggugauauu

SEQ ID NO: 4251150 - RNA, 59 nt, Staphylococcus aureus subsp. aureus Mu50
gaacaaugcguuagucgaugccuuaaauauuuagaagugcauugucuaacguauuuuuu

SEQ ID NO: 4251151 - RNA, 56 nt, Staphylococcus aureus subsp. aureus Mu50
uuuguacaaucauaaacugguguccuguuuuaagggcaucaguuuuuuuauacgag

SEQ ID NO: 4251152 - RNA, 55 nt, Staphylococcus aureus subsp. aureus Mu50
agaaaaaggauuggucgaaugaacuucauguucuauguucgaccaauccuuuucu

SEQ ID NO: 4251153 - RNA, 65 nt, Staphylococcus aureus subsp. aureus Mu50
uggagugggaagauggaaaagaauacccaguuauucguuuagauauuucaucugauucacaucca

SEQ ID NO: 4251154 - RNA, 73 nt, Staphylococcus aureus subsp. aureus Mu50
aucgauuagcaacaauuguaaaguuugaaaugucucaaaaggcauauucaacugacguuguuuguuaaucgau

SEQ ID NO: 4251155 - RNA, 92 nt, Staphylococcus aureus subsp. aureus Mu50
aauagaauugacuguuuaaaacgauuguuuauguugacgcuacgguugucacguagagauuaaagacauucguuuuagcagucuuuuuuauu

SEQ ID NO: 4251156 - RNA, 64 nt, Staphylococcus aureus subsp. aureus Mu50
gcgguguaucauucuucuugaaacgucugauaacuuuaacaggcauugggaaugauaacaacgc

SEQ ID NO: 4251157 - RNA, 66 nt, Staphylococcus aureus subsp. aureus Mu50
ugccauagcguuugaguugcgaaaacauguucaacuucacuuguuccaauuccaaaugcaauagca

SEQ ID NO: 4251158 - RNA, 58 nt, Staphylococcus aureus subsp. aureus Mu50
guuggggugggacaacgaaauaaauuuugcgaaaauaucauuucugucccacucccac

SEQ ID NO: 4251159 - RNA, 95 nt, Staphylococcus aureus subsp. aureus Mu50
ucaaguuauuuaguuugauuuguacuucaucauauuguuguugcuuauaagcaauaucgugaugaagugcagcgccaucaacuugauuuucuuga

SEQ ID NO: 4251160 - RNA, 61 nt, Staphylococcus aureus subsp. aureus Mu50
gugaaaugcucccuucaaagccuucauuuauucaaugucuacuuugaagggagcauuugau

SEQ ID NO: 4251161 - RNA, 60 nt, Staphylococcus aureus subsp. aureus Mu50
gaauucuucacccauuguuacaccugaauauggugcaauauauaauaauggagaagguuc

SEQ ID NO: 4251162 - RNA, 130 nt, Staphylococcus aureus subsp. aureus Mu50
aaguucguaaaaaauccaauggauauugucaguguuggugauaucguugacguuuggguuuacaguauugacaaaaauaaagacaaaguaucauuaacgaugauugauccacaugaauaaugacaaacuu

SEQ ID NO: 4251163 - RNA, 55 nt, Staphylococcus aureus subsp. aureus Mu50
gcuaguuuaucuagauuagguuuaaaauacuuagauuuguaucuaguacauuggc

SEQ ID NO: 4251164 - RNA, 113 nt, Staphylococcus aureus subsp. aureus Mu50
guucauuuuuaaaaccuaaaaaucaauuaccuaugguuggaacaauaucuuuagugccacaaauuguagaugucguuucaauuccggucauugccgcugguggaauuauggac

SEQ ID NO: 4251165 - RNA, 57 nt, Staphylococcus aureus subsp. aureus Mu50
aaacacgcgguaaaacgaagucagucaauucaaacugauuucgcccaccgcguguuu

SEQ ID NO: 4251166 - RNA, 56 nt, Staphylococcus aureus subsp. aureus Mu50
uuaaaggcauaauaaccauagugcguaucgagcguaauggauuauuaugccuuuga

SEQ ID NO: 4251167 - RNA, 55 nt, Staphylococcus aureus subsp. aureus Mu50
agagacgggagauuucuacgagccaaacugcuaguguaggaaucucuuugucuuu

SEQ ID NO: 4251168 - RNA, 92 nt, Staphylococcus aureus subsp. aureus Mu50
uagugguacuacuguugcugguguucauacgguucaaucaaaugccaacacauuagaucaagcgaugaauacguuaagacaaaguauugcua

SEQ ID NO: 4251169 - RNA, 80 nt, Staphylococcus aureus subsp. aureus Mu50
gggauucaaaaugcuuggcguaaguauucaaaaguuacaauuauuaggugcgaugccaagacauguuauugaaggauucc

SEQ ID NO: 4251170 - RNA, 69 nt, Staphylococcus aureus subsp. aureus Mu50
guucuuuagauguuuuaguaaauaaugcagguauuacucgcgauaauuuauuaaugcguaugaaagaac

SEQ ID NO: 4251171 - RNA, 64 nt, Staphylococcus aureus subsp. aureus Mu50
gaugaauggaaagauugguugaagcacgucuucgaacaagauauugccaauuuaucuauucauc

SEQ ID NO: 4251172 - RNA, 84 nt, Staphylococcus aureus subsp. aureus Mu50
uguuguuaaaacaucacaaugauguacaugcucauuuuggaaauauguguucaaaguguguacaucgugugacgauugaugaua

SEQ ID NO: 4251173 - RNA, 62 nt, Staphylococcus aureus subsp. aureus Mu50
guugauguugcuaacuucuuaacaaguaugggagcuaauauuaagggagcgggcacaucaac

SEQ ID NO: 4251174 - RNA, 88 nt, Staphylococcus aureus subsp. aureus Mu50
auauaagaaauccaccuacgauucgaaauagguaucuuaaagcauaucucaagauauccauuaugauguagauggacaguuuuuauau

SEQ ID NO: 4251175 - RNA, 68 nt, Staphylococcus aureus subsp. aureus Mu50
guggagaaaaaguacguuguaugcuaaguaaaaugauguuaucaagugcgaauguacuuuuacuugac

SEQ ID NO: 4251176 - RNA, 67 nt, Staphylococcus aureus subsp. aureus Mu50
ucggcauuuuaauuguaauauugcgcuucacacagaaguuauaaacaauaacaguuacaaaugcuga

SEQ ID NO: 4251177 - RNA, 74 nt, Staphylococcus aureus subsp. aureus Mu50
ugguuaaacauuguucaaacaucacaaugauaaagcauauuaucaguauuguaguguguggaaaaugacagcca

SEQ ID NO: 4251178 - RNA, 97 nt, Staphylococcus aureus subsp. aureus Mu50
uauuauuuugugagugaagcauuuucggauuugccauaugacuaugaucgaccggggucaaaucgcaaaccgauucauuuauuaagacaagauggua

SEQ ID NO: 4251179 - RNA, 77 nt, Staphylococcus aureus subsp. aureus Mu50
aaauuguaaccguugaaagaggacaaagauuaacaucuauuuugaccuugucugaccuuuuuaacuggucacgauuu

SEQ ID NO: 4251180 - RNA, 59 nt, Staphylococcus aureus subsp. aureus Mu50
aaagacuuggucgaaucguggaugauauauuaucaaacgcacggcucgaacaagucuuu

SEQ ID NO: 4251181 - RNA, 65 nt, Staphylococcus aureus subsp. aureus Mu50
acaucuaacaguaaacauuuaggcaguauaguuuaaaaucacugcgcaaugauacugucagacgu

SEQ ID NO: 4251182 - RNA, 74 nt, Staphylococcus aureus subsp. aureus Mu50
gcauuguguacgacaccauuacaguuuguacuugugagguuauugcagggacuauuuggugguguuguugaugc

SEQ ID NO: 4251183 - RNA, 70 nt, Staphylococcus aureus subsp. aureus Mu50
gcuuccgguaauuaucaagugccauuuucgauuggguuauacaaucuagaaucgcaugauaauuuaaugc

SEQ ID NO: 4251184 - RNA, 98 nt, Staphylococcus aureus subsp. aureus Mu50
uaacacauaccucaacuuagcuaaacaacguuuuaaaugcuuagaaugcaauggcacuuuuacugcuaaaacgucaauuguugaugagucguguuuua

SEQ ID NO: 4251185 - RNA, 109 nt, Staphylococcus aureus subsp. aureus Mu50
ugaauuagcauuuuacgaucauaaacagucauuauaauugaguauuugaacauaaaaauguaauuuuaucgucacaauuuggguguuugugauuguuuuugguaauuua

SEQ ID NO: 4251186 - RNA, 65 nt, Staphylococcus aureus subsp. aureus Mu50
gugguucgucauuuuaaucaaauucaaacgaaagugcgggagcaugauuuuagaugggaaccuac

SEQ ID NO: 4251187 - RNA, 65 nt, Staphylococcus aureus subsp. aureus Mu50
ucauuggaggagugguuaaaugaaaacaauacauuuguuucgcaucuaccacucuuuuuuauuga

SEQ ID NO: 4251188 - RNA, 62 nt, Staphylococcus aureus subsp. aureus Mu50
aauacacuaaucgcacguacucacccuuuauuacagugauacggucauacgauuaguguguu

SEQ ID NO: 4251189 - RNA, 80 nt, Staphylococcus aureus subsp. aureus Mu50
guagguacugcuucaauuuuaguagggacaacauugauuuuuggguuaaguggucaugaagcuaaagcggcagaacauac

SEQ ID NO: 4251190 - RNA, 69 nt, Staphylococcus aureus subsp. aureus Mu50
ucugccucauguucaauugucuuauauucuucaggagauaauaagucgaauugaauaugacgauguaga

SEQ ID NO: 4251191 - RNA, 84 nt, Staphylococcus aureus subsp. aureus Mu50
ugguagguuugauugaaaauguaaauuauuuaaaugauuuugaaccucaaguuggagauaaauuauauuuaaucggugauacua

SEQ ID NO: 4251192 - RNA, 94 nt, Staphylococcus aureus subsp. aureus Mu50
auaauuaagaucgaaugaauuauaagaguaggaaaaagcugaaagaaaucugaugcuuauguccugcucuuauuauuuuugauauaaugauuau

SEQ ID NO: 4251193 - RNA, 113 nt, Staphylococcus aureus subsp. aureus Mu50
agcuauuccaacgccaauauauacaauauaaaugagagucacccuauaaaguucggcacugcugugagacgacuuuaucgggugcuuuuuuauguuauuggugggaaauggcu

SEQ ID NO: 4251194 - RNA, 60 nt, Staphylococcus aureus subsp. aureus Mu50
uauaaugacguuauuaauacaaugaaaggcauuucagugacuuguuaaugaugcauugua

SEQ ID NO: 4251195 - RNA, 83 nt, Staphylococcus aureus subsp. aureus Mu50
uaacaaaaugaugauaaacuaguauacauugugguaaaaguaguaaugaccaguuguuacuaguaauuaucagcauuugguua

SEQ ID NO: 4251196 - RNA, 57 nt, Staphylococcus aureus subsp. aureus Mu50
auugauugggcaauggaaguuacaggaacugauacauuccgacaccguucaaucaau

SEQ ID NO: 4251197 - RNA, 78 nt, Staphylococcus aureus subsp. aureus Mu50
aaguacagaaaaagggcagaauauacaacuguuaacuauuuaaauuagcaguuuauauucugucuuuuuauauggcuu

SEQ ID NO: 4251198 - RNA, 70 nt, Staphylococcus aureus subsp. aureus Mu50
aaaagaccuucaacauguaggagacaagacgaaacgaaucgcuauuucccuuuacaugugaaggucuuuu

SEQ ID NO: 4251199 - RNA, 79 nt, Staphylococcus aureus subsp. aureus Mu50
uaaagguuuggauaaugucguuaucaauaaauucaccaguuuguugaaugauuuguugaugauauuuaugaauucuuug

SEQ ID NO: 4251200 - RNA, 74 nt, Staphylococcus aureus subsp. aureus Mu50
uauugccauuaucgauucuugguuuggaaagauauuuucaacaacgcaaaaucgguauuuucauuguugcgaua

SEQ ID NO: 4251201 - RNA, 77 nt, Staphylococcus aureus subsp. aureus Mu50
auaauaaaagcuauaguguuuguaauauucggaugcgguuaagcagccccugauauuaaacacuauagcuuuuuugu

SEQ ID NO: 4251202 - RNA, 72 nt, Staphylococcus aureus subsp. aureus Mu50
ggaugcauauauauauagauuaaaccgcacuucuauauuaauagaaagugcgguuauuuauacagugaaucu

SEQ ID NO: 4251203 - RNA, 73 nt, Staphylococcus aureus subsp. aureus Mu50
gggugaaguuuuagaaauugucaaugaugaagaagcaauuguucaaaugggaauuauuaaaaugaaguuaccu

SEQ ID NO: 4251204 - RNA, 59 nt, Staphylococcus aureus subsp. aureus Mu50
ucauuaggauuuggugaaccguauccgauaucagggucacaugguuuaggucuugguga

SEQ ID NO: 4251205 - RNA, 130 nt, Staphylococcus aureus subsp. aureus Mu50
uaaaaugggauuacaaauuaggcauuauacgguucagucuuuaaaacuguugaaaacacauuuuaauguugagguuuaguaaagaaggacuaaauugaugaugcugucaugaugguuaauaacauuuaug

SEQ ID NO: 4251206 - RNA, 96 nt, Staphylococcus aureus subsp. aureus Mu50
gccgaauguaaggauauuauuaaaagauguauuuguuucagguguaucaauagaucauuuaugguuauaugagacaaauaaauacuaugcauuggc

SEQ ID NO: 4251207 - RNA, 60 nt, Staphylococcus aureus subsp. aureus Mu50
gguuuguuauuccaucaaagcauauuguguguucaguagguuuugauaggcuaacaagcc

SEQ ID NO: 4251208 - RNA, 55 nt, Staphylococcus aureus subsp. aureus Mu50
aaagcucucuucauaaucauguuguaguuuuuguugacaugaugaagagaguuuu

SEQ ID NO: 4251209 - RNA, 73 nt, Staphylococcus aureus subsp. aureus Mu50
gauaauuggaauggcuuuuguuuuauuaacuguuuaauauaguguugauauggacaugauucuucuaauuguu

SEQ ID NO: 4251210 - RNA, 65 nt, Staphylococcus aureus subsp. aureus Mu50
ggcaagguugacuagaauugaaaaaagcuuguuacaagcgcauuuucauucagucaacuacugcc

SEQ ID NO: 4251211 - RNA, 77 nt, Staphylococcus aureus subsp. aureus Mu50
ucgaaaauaguugaucugccuaaguauauacaguagaauauacaaguauguguuagucagauagcacuauuauguga

SEQ ID NO: 4251212 - RNA, 56 nt, Staphylococcus aureus subsp. aureus Mu50
gaaaagcuccaaucaaaguugacgcucaaauaguuuaacuuugaucggagcuuuuu

SEQ ID NO: 4251213 - RNA, 128 nt, Staphylococcus aureus subsp. aureus Mu50
ucauaagugaguaaucauaaucauaaauuauagcgaauuguacauaaacaacagcaguaaggcauuuuuauaaugaaacgccucaugcugcuguuuuuauuacugaaaaugacuucuacacuaaauga

SEQ ID NO: 4251214 - RNA, 56 nt, Staphylococcus aureus subsp. aureus Mu50
uuauuagaacuaauggagggcaacguugaauucguugccagccuugguucagauga

SEQ ID NO: 4251215 - RNA, 98 nt, Staphylococcus aureus subsp. aureus Mu50
aauguagauguucuuuagacauuaaaagcuucuaacaugauacggaauaugagguuccuguaucacauuagaagcuuuuuuguugcggugcuuauauu

SEQ ID NO: 4251216 - RNA, 65 nt, Staphylococcus aureus subsp. aureus Mu50
ggguuaugugcagcuaugauuuuauugauuuccauaucacguguauaucuagguguacauuaucc

SEQ ID NO: 4251217 - RNA, 65 nt, Staphylococcus aureus subsp. aureus Mu50
gaugacauauuuuaauagugaauauauuuugagauauuaauauauuuaauguuaaggauguuguc

SEQ ID NO: 4251218 - RNA, 73 nt, Staphylococcus aureus subsp. aureus Mu50
uaaauugggauuaaaugauucuuuauugguacagugguggcauuggaugaaucauuuauuacauuuuaauuua

SEQ ID NO: 4251219 - RNA, 59 nt, Staphylococcus aureus subsp. aureus Mu50
uacuuauuuuaacaucuagcgguacaagcgucuuggaggcuaguauguugaacauugua

SEQ ID NO: 4251220 - RNA, 72 nt, Staphylococcus aureus subsp. aureus Mu50
gugauucaacauuugauguugagauggcgcaacaugcugguguaccaucugcagcaguaacauggggagcac

SEQ ID NO: 4251221 - RNA, 95 nt, Staphylococcus aureus subsp. aureus Mu50
acucgauacauauaucucaacaacauagaaauauuacagucgcuacaccgcaucuuaaauggugugguuauuuuuauuggaaguguguaucaggu

SEQ ID NO: 4251222 - RNA, 72 nt, Staphylococcus aureus subsp. aureus Mu50
auaucgugacaaacguaaucaucgugguaacaauaauccaguuauugcgcaauuuacguuuugucaucguau

SEQ ID NO: 4251223 - RNA, 57 nt, Staphylococcus aureus subsp. aureus Mu50
gaaaugccccuuucgaaguagacauugaaaaaaugaaaacuuugaagggagcauuuc

SEQ ID NO: 4251224 - RNA, 82 nt, Staphylococcus aureus subsp. aureus Mu50
gacagaugcguuacaagaacauguuaaucaacaaauucgucaaccaaugcgagaagauaugucauuuguaacgcguuuuauc

SEQ ID NO: 4251225 - RNA, 65 nt, Staphylococcus aureus subsp. aureus Mu50
uggauauggcgaaacuaauguauuaucuugcaauugaugacguacacuuuuagucgccuuaacca

SEQ ID NO: 4251226 - RNA, 97 nt, Staphylococcus aureus subsp. aureus Mu50
ugauuuuaugagggcugguggcucuauuaaugguguuaugaauuuaaugaaugaguuuaaagcccauguaaaagggguaucaguacuuguagaauca

SEQ ID NO: 4251227 - RNA, 67 nt, Staphylococcus aureus subsp. aureus Mu50
caaccgaugccaauuggggccgucucuauaauuggauuuacaaucaugguacucguuggcauuguug

SEQ ID NO: 4251228 - RNA, 59 nt, Staphylococcus aureus subsp. aureus Mu50
uauugugauuagugcacgaacagaggaacaaaccauugucgaaguauuagaucgcggug

SEQ ID NO: 4251229 - RNA, 77 nt, Staphylococcus aureus subsp. aureus Mu50
ggugauuugaaaaguaagcuaucugagauaauugcugauaacauuaaaccggcaauuucagguuuaauuucaaagcc

SEQ ID NO: 4251230 - RNA, 78 nt, Staphylococcus aureus subsp. aureus Mu50
uaauaccauuuuuaauaauuauauuguugcauucuaaauuuagauucaaugcuguaaguaugauauuaguagguguug

SEQ ID NO: 4251231 - RNA, 71 nt, Staphylococcus aureus subsp. aureus Mu50
ucauuauaguuaauacaaugcugagauaaccauaguaaccauguuguuaaagcauuuuuuaauuggaauga

SEQ ID NO: 4251232 - RNA, 65 nt, Staphylococcus aureus subsp. aureus Mu50
aucgauuuuuaguuauugcacauucguaucaguuaaaugcgagaguuuuggugacuaaaaaagau

SEQ ID NO: 4251233 - RNA, 113 nt, Staphylococcus aureus subsp. aureus Mu50
ccacaccuugcauuuaaaaugacagaucaaauuuuucuaaauaagcagcguguauuagauaagguaaaaguuuuagauaaggaauuugauuuuaucuuaauugagggugcugg

SEQ ID NO: 4251234 - RNA, 65 nt, Staphylococcus aureus subsp. aureus Mu50
aaacuaaaacugacuaguucgcaagcauaguagaauaugccucguguacuagucaguuuugauuu

SEQ ID NO: 4251235 - RNA, 66 nt, Staphylococcus aureus subsp. aureus Mu50
ugagacgauaccccaacuuucauuuacuugcauuacugcauuuagauaauuuaguugggguacuca

SEQ ID NO: 4251236 - RNA, 62 nt, Staphylococcus aureus subsp. aureus Mu50
guugaugugcccgcucccuuaauauuagcucccauacuuguuaagaaguuagcaacaucaac

SEQ ID NO: 4251237 - RNA, 65 nt, Staphylococcus aureus subsp. aureus Mu50
ccuacuucaucaagcaauuguuucguaccacuaaaugaagcgauuuuacuugaagauacaguugg

SEQ ID NO: 4251238 - RNA, 130 nt, Staphylococcus aureus subsp. aureus Mu50
agauaaauacuuuuuacguuuuacuaauuuuauugguauagguugcuuuuucguugcugcaggugcauaaauaacaacggaaaucaauccuauaauagauaaggccaguaaauaaguaaaauuaaugucu

SEQ ID NO: 4251239 - RNA, 60 nt, Staphylococcus aureus subsp. aureus Mu50
aaucaaauuauauugagccguuugaaucaaaauuggaugugucgguaaauugauuugauu

SEQ ID NO: 4251240 - RNA, 81 nt, Staphylococcus aureus subsp. aureus Mu50
auucuauugccaucugcaacauauugaucaauuaauacuuuuacuuuagcuaauuguucugguguugcgaucgcuuugaau

SEQ ID NO: 4251241 - RNA, 80 nt, Staphylococcus aureus subsp. aureus Mu50
ugucuuuagcaucuuguagucguugaucaccauuaagauuauggauugcaucauugacugcuuggauugcgccauugaua

SEQ ID NO: 4251242 - RNA, 78 nt, Staphylococcus aureus subsp. aureus Mu50
gccgaaucaugucgcugugcaauuugacggaguguuuauaacauaucaaacauugaaugcacgcgcgaaugauuuagc

SEQ ID NO: 4251243 - RNA, 77 nt, Staphylococcus aureus subsp. aureus Mu50
uagauggcauaaugugauaaauuuugacggaaauuuuuaaauauuaucucguuaaaggucauaauuaacgccaccua

SEQ ID NO: 4251244 - RNA, 67 nt, Staphylococcus aureus subsp. aureus Mu50
gaagaagacuuauuuacugcguuugcugaagauaaugcacaagcaaaugcguuuacaagcuuugauc

SEQ ID NO: 4251245 - RNA, 74 nt, Staphylococcus aureus subsp. aureus Mu50
acauacaaaauaaagcgaccaauuuugcaguguuacgaauuguaaacugcgaacuggucgcuuuuuauugaugu

SEQ ID NO: 4251246 - RNA, 73 nt, Staphylococcus aureus subsp. aureus Mu50
uuauuaauuaagaucaguugaguaguuguguuuauugauuuauaugaaacuacucauuugaagccguugauga

SEQ ID NO: 4251247 - RNA, 76 nt, Staphylococcus aureus subsp. aureus Mu50
gaguagagaaaauaauaaguaguagaauuuaagcaaauucuuuguugaaccagucacugcuuguuauuauuuacuu

SEQ ID NO: 4251248 - RNA, 85 nt, Staphylococcus aureus subsp. aureus Mu50
gucgguuaggugcaaaugucuaugugaguauugaaaaugguauaaaaucauuaaguauugacgauagaggcuuugcacgacaaac

SEQ ID NO: 4251249 - RNA, 59 nt, Staphylococcus aureus subsp. aureus Mu50
caaaguaaaauucuugugacaugacaugugcuauguucuguuacaagaauuuuuguuug

SEQ ID NO: 4251250 - RNA, 63 nt, Staphylococcus aureus subsp. aureus Mu50
uuugaauugcccaaacggcgugaacugucgcauagucaaauucuacaccuuggccgauucgaa

SEQ ID NO: 4251251 - RNA, 63 nt, Staphylococcus aureus subsp. aureus Mu50
acaaaagaggcgccacaacauguuuggaugaacaaaauaacauguuuguggcaccucuuuugu

SEQ ID NO: 4251252 - RNA, 68 nt, Staphylococcus aureus subsp. aureus Mu50
ucauuaaugucuacguaugaaucuagcuaggacauucccuagcguuugaaucacuuggacaauaauga

SEQ ID NO: 4251253 - RNA, 61 nt, Staphylococcus aureus subsp. aureus Mu50
guuguuauaaauugauaauaggguuaaacauuacuuuguuucgcccuugauuuuuggcuac

SEQ ID NO: 4251254 - RNA, 71 nt, Staphylococcus aureus subsp. aureus Mu50
gauuauugcugguuuuggucuuauuuucuuugguuuuggaaaugguggccaugcgguagguauuucuaauc

SEQ ID NO: 4251255 - RNA, 66 nt, Staphylococcus aureus subsp. aureus Mu50
guuuaaaucuuuuuauaaaagaacguaacuucauguuaacguuugacuuauaaaaaugguggaaac

SEQ ID NO: 4251256 - RNA, 63 nt, Staphylococcus aureus subsp. aureus Mu50
gugguacuuguaagguuucagaaagaauguuagacauugcuaaugaaauauugcaguuaccau

SEQ ID NO: 4251257 - RNA, 57 nt, Staphylococcus aureus subsp. aureus Mu50
uagcuuggaaugaagcuuggauugacuuuucaguaucauuaguuccaguuccagcua

SEQ ID NO: 4251258 - RNA, 57 nt, Staphylococcus aureus subsp. aureus Mu50
ggugauguagguaagaacuucggucaagguaugaguggugguauugcuuacguuauc

SEQ ID NO: 4251259 - RNA, 79 nt, Staphylococcus aureus subsp. aureus Mu50
gugguauaagaacgcauggcgacaucgcuaaaucaauuagauuuggugcaucaauggucaugauugguucauuauuugc

SEQ ID NO: 4251260 - RNA, 65 nt, Staphylococcus aureus subsp. aureus Mu50
ggcaagguugacuagaauugaaaaaagcuuguuacaagcgcauuuucguucagucaacuacugcc

SEQ ID NO: 4251261 - RNA, 60 nt, Staphylococcus aureus subsp. aureus Mu50
cgaguacggcauuuauuuucuuaccagcauuaauugguuggaguaguaugcguguauuug

SEQ ID NO: 4251262 - RNA, 75 nt, Staphylococcus aureus subsp. aureus Mu50
agacaugaugguuaauggcgguguacuuauggcacauuuaaaugccaaaagugguccgugguuaaaagaugugcu

SEQ ID NO: 4251263 - RNA, 73 nt, Staphylococcus aureus subsp. aureus Mu50
cgguauuguuuuauauccaccccacgauaagccccggaaacuuauuguguuacaagauauauaagcagaaacg

SEQ ID NO: 4251264 - RNA, 69 nt, Staphylococcus aureus subsp. aureus Mu50
cccagaugcgacaaaaguauuuacguaugugacuaccaucucuacaguguuauuuuuaguuguaugggg

SEQ ID NO: 4251265 - RNA, 96 nt, Staphylococcus aureus subsp. aureus Mu50
gcuuuagaugcagcuaaaagugcuuuggguauucacucaccuucacgugaauucauggauguugguauguauucaaugcuagguuucguuaaaggu

SEQ ID NO: 4251266 - RNA, 124 nt, Staphylococcus aureus subsp. aureus Mu50
ggugauuacauuacugggacuuuccaaguuaaagauuuaccgaaugcgaauccuaaaucaaaugucauuccaaaagguaaauauuuaguucuuggagauaaucgugaaguaaguaaagauagcc

SEQ ID NO: 4251267 - RNA, 66 nt, Staphylococcus aureus subsp. aureus Mu50
aaggugggggaguugaaugauaaauaaguuuucauaugcuuguuuaucuaauaauacccucauguu

SEQ ID NO: 4251268 - RNA, 55 nt, Staphylococcus aureus subsp. aureus Mu50
ugggagugggacagaaaugauauuuucgaaaaauuuauuucgucgucccacccca

SEQ ID NO: 4251269 - RNA, 78 nt, Staphylococcus aureus subsp. aureus Mu50
gauacaguaccgugacucuucguaucauaguuucuaaauguagaaccgucaacuugauaugaagauucaucuugaauc

SEQ ID NO: 4251270 - RNA, 58 nt, Staphylococcus aureus subsp. aureus Mu50
auaacaaagcgcuugcuaguaccucuuaaaaagaugaugcuagcaagcgcuuuucuau

SEQ ID NO: 4251271 - RNA, 83 nt, Staphylococcus aureus subsp. aureus Mu50
uaguuuguggucuagauuuaucuaaauccaauguaucaaauacuuguuccauuggugguaaaucuuuaaauugaccgccacua

SEQ ID NO: 4251272 - RNA, 84 nt, Staphylococcus aureus subsp. aureus Mu50
guugaugaaagcuuuccaaauugaugcaucaguaaauccagguaacucggguggugcugucgucaauagagaaggaaaauuaau

SEQ ID NO: 4251273 - RNA, 92 nt, Staphylococcus aureus subsp. aureus Mu50
gcgacaucugugugacgauaaugauaagcgacaguuaauaauuugugauuuuuauuagccgcuucaaucaugcgaucacacucuuccgucgu

SEQ ID NO: 4251274 - RNA, 81 nt, Staphylococcus aureus subsp. aureus Mu50
cauucugucauuguggguacgauuaugauugcaauuucauuauauauugcaacagacguagcacccauuuucacagauaug

SEQ ID NO: 4251275 - RNA, 88 nt, Staphylococcus aureus subsp. aureus Mu50
aauaauccauccguaugacccauguuugaaaguaaucguugcaauacgauaacuuauuaauacaugcguuuauaacggauggauuuuu

SEQ ID NO: 4251276 - RNA, 56 nt, Staphylococcus aureus subsp. aureus Mu50
uuggacuagaaaugguagauaaugaacuuucugauuaucuaccguugaugcuucaa

SEQ ID NO: 4251277 - RNA, 59 nt, Staphylococcus aureus subsp. aureus Mu50
accaagcacagaaagaugcauuaaaacaacaaguacaaaaugcaacuacuguagcuggu

SEQ ID NO: 4251278 - RNA, 79 nt, Staphylococcus aureus subsp. aureus Mu50
cggaauuaacaaucaucagcgauuuaauauuugacuggagacgucaugguaauaaaaaauugaugagaaauugauggug

SEQ ID NO: 4251279 - RNA, 63 nt, Staphylococcus aureus subsp. aureus Mu50
cugguucaagugguaacugcuacgucuuaaaugauggacguacuacguuacuauuugaggcag

SEQ ID NO: 4251280 - RNA, 63 nt, Staphylococcus aureus subsp. aureus Mu50
acaagcaaaaauagcggugauuguuuaccaucaauuuuaacaaucaccgcuacuuuugcuugu

SEQ ID NO: 4251281 - RNA, 64 nt, Staphylococcus aureus subsp. aureus Mu50
uuguucugucguaaugauguaauaaccacguucacuagguuuauaacugcauccgauaggauag

SEQ ID NO: 4251282 - RNA, 68 nt, Staphylococcus aureus subsp. aureus Mu50
uguagugcguuaaaggauauuaagauuguuguaagcauauuuaauaauuuaucuauugacgaauugca

SEQ ID NO: 4251283 - RNA, 129 nt, Staphylococcus aureus subsp. aureus Mu50
gucuuuuggcgucauuaauauuuuguugcaauuugucauguuaaaagaagauaugaaacuuccuaaagcguauauuuuggaaauagcaucaaauuggaagaaaaaagguauuaagacagcuaaagaagc

SEQ ID NO: 4251284 - RNA, 68 nt, Staphylococcus aureus subsp. aureus Mu50
ugaacgccaaaugcugucgucuacuuuuaaauuuucaauacuuagagguaucucauauuuggccauca

SEQ ID NO: 4251285 - RNA, 70 nt, Staphylococcus aureus subsp. aureus Mu50
uucugcgauauguuguugugcaucaugugauacagcaucccuugcagcuugcuuaacaacaguuacagga

SEQ ID NO: 4251286 - RNA, 72 nt, Staphylococcus aureus subsp. aureus Mu50
cauuuuauagugacuggugguacgagugguuuagguuuaucgauuguccgaaaguuacuagaaaauaaagug

SEQ ID NO: 4251287 - RNA, 100 nt, Staphylococcus aureus subsp. aureus Mu50
aaaugggcgucuuuaccgauaaauacgguguucguuggauguuacauggucaagacuauacugcaauccaacaauaauguuauugauaaagauaucauuu

SEQ ID NO: 4251288 - RNA, 75 nt, Staphylococcus aureus subsp. aureus Mu50
uuuuaagguagacgaggucagauuaacuuguuuguuauaggcaaacuuuuuauacuggccucuuaugccguaaaa

SEQ ID NO: 4251289 - RNA, 58 nt, Staphylococcus aureus subsp. aureus Mu50
agcuguuguagcagguguaguuugauuaauaucauugauugcuuuuguuuuaauggcu

SEQ ID NO: 4251290 - RNA, 118 nt, Staphylococcus aureus subsp. aureus Mu50
aggaauuagaaaguuuagcagguguaggacguaaaacugcuaauguagucaugaguguagcauuugaugaaccuucauuagcuguugauacgcauguagaacguguuucuaaacgcuu

SEQ ID NO: 4251291 - RNA, 68 nt, Staphylococcus aureus subsp. aureus Mu50
auaauaaaagacacaucuauacgaugaucauuuacaaugauugcguauagugaugugucuuuuuuugu

SEQ ID NO: 4251292 - RNA, 55 nt, Staphylococcus aureus subsp. aureus Mu50
aaaaacuucuaucacgaacgcuucaauuuccuguaugcgugugauagaaguuuuu

SEQ ID NO: 4251293 - RNA, 71 nt, Staphylococcus aureus subsp. aureus Mu50
gguucacaugcacgauuaucuuuaucucuaucuaaauguggacgauaugcuggaugaucggcagugacacc

SEQ ID NO: 4251294 - RNA, 66 nt, Staphylococcus aureus subsp. aureus Mu50
gucaaaagaaaacagcaguaaaaucauuccuaauuuggaaucaucuuacugcuguuuguuguugau

SEQ ID NO: 4251295 - RNA, 61 nt, Staphylococcus aureus subsp. aureus Mu50
agcaagugauuugccuaauguuuuuguuucuucuaaaaaugauggugauaaauuacuuguu

SEQ ID NO: 4251296 - RNA, 73 nt, Staphylococcus aureus subsp. aureus Mu50
gguaaaaccuguugauacaacuggggcaggggaugcuuuuauuggugcaguuauuagcaggauuuuagcaacc

SEQ ID NO: 4251297 - RNA, 59 nt, Staphylococcus aureus subsp. aureus Mu50
cuaauuaauauugcagaagagaagauguguuacaucuucucuucuuuuuuauugguuag

SEQ ID NO: 4251298 - RNA, 95 nt, Staphylococcus aureus subsp. aureus Mu50
cggcagcagaaguaucacauccaaguaaacaaggucuaguacaagcauuuucaguuuauauugauacauuauuuguauguacugcaacugcucug

SEQ ID NO: 4251299 - RNA, 88 nt, Staphylococcus aureus subsp. aureus Mu50
auccagaaccacagucauaaucauuucuuguguuuacucagucguuugagacugcaucaugauugaaagauuauuugugauucuggau

SEQ ID NO: 4251300 - RNA, 57 nt, Staphylococcus aureus subsp. aureus Mu50
ugaauaagaaaucggacuuaugaacagaaauauguuuaaguccgaacuccuuguuua

SEQ ID NO: 4251301 - RNA, 67 nt, Staphylococcus aureus subsp. aureus Mu50
gaagaguuugaaugauaacucauugcauuuaaagauaaauggcaugcguuaugauuuaaagcucuuc

SEQ ID NO: 4251302 - RNA, 55 nt, Staphylococcus aureus subsp. aureus Mu50
aaauuaucgggcuguauuuuacaaauaaucuugaaaaagagcugcuugauaauuu

SEQ ID NO: 4251303 - RNA, 61 nt, Staphylococcus aureus subsp. aureus Mu50
gugacagcauccucaggucuacguucuggaauacuacguacaacuucagguaugaugucac

SEQ ID NO: 4251304 - RNA, 60 nt, Staphylococcus aureus subsp. aureus Mu50
ccuuaauauucgacgauagcggggcguguaugacguucugcaaguuuucggauaaauagg

SEQ ID NO: 4251305 - RNA, 61 nt, Staphylococcus aureus subsp. aureus Mu50
ugauuuauucgcagcuguaggauuuggcggcgugacauccuuacagauuguuaauaaauua

SEQ ID NO: 4251306 - RNA, 65 nt, Staphylococcus aureus subsp. aureus Mu50
uaguagcuggcaaggaaaugaaauugucuuacauaaagacauuaauauuucaauugcuguugcug

SEQ ID NO: 4251307 - RNA, 57 nt, Staphylococcus aureus subsp. aureus Mu50
uuugccauugaaagaaaagcguaaagcaagaaaagccauugaaucuuucguggcaga

SEQ ID NO: 4251308 - RNA, 74 nt, Staphylococcus aureus subsp. aureus Mu50
agcgaaaaauaaugugcgcccuauaaaguuaaaauuaucuucaacuuuuagggugcacauuauuuggacuugcu

SEQ ID NO: 4251309 - RNA, 72 nt, Staphylococcus aureus subsp. aureus Mu50
guauauauugcaggugguguugaaaguacaagucgagcaccuuggaaaaucaaacgaccgcauucuguguac

SEQ ID NO: 4251310 - RNA, 57 nt, Staphylococcus aureus subsp. aureus Mu50
uauuaauguuaaauugcucaguuaguaccgacauaacugguguaggaaacguuaaua

SEQ ID NO: 4251311 - RNA, 60 nt, Staphylococcus aureus subsp. aureus Mu50
cauuuguugcugcuugauucaccugacuauucguuugagcuuggucaauagcugcaagug

SEQ ID NO: 4251312 - RNA, 57 nt, Staphylococcus aureus subsp. aureus Mu50
uaguaggaauacaaccuuuauggagacaaguaccuccuaauaguugucguucuacua

SEQ ID NO: 4251313 - RNA, 58 nt, Staphylococcus aureus subsp. aureus Mu50
cauauagcguucucgcauaaguagguuuauuaaucugcaaauguugagcgcauauuug

SEQ ID NO: 4251314 - RNA, 60 nt, Staphylococcus aureus subsp. aureus Mu50
aaugaauaaguaagguuucaaccgagagaauauauucguguugaagccuuauuugucguu

SEQ ID NO: 4251315 - RNA, 74 nt, Staphylococcus aureus subsp. aureus Mu50
gcuaauucaguagaagaauauuuagcacccuuaaaagaaauguuugcgaaauauguaccugcugacgaaguagc

SEQ ID NO: 4251316 - RNA, 84 nt, Staphylococcus aureus subsp. aureus Mu50
uagguucgguugcauuagcgauuuauaugcuuguuguuucuaucaaacguaaaaguacauuuaaucgcuagaaaauugauuuua

SEQ ID NO: 4251317 - RNA, 60 nt, Staphylococcus aureus subsp. aureus Mu50
aguucggcgcuguauauuuaacaccaacaauuuuuucgugauuaaauagcucgcugaauu

SEQ ID NO: 4251318 - RNA, 70 nt, Staphylococcus aureus subsp. aureus Mu50
guaauaaaaacgcuucauauaaaggucgagucaauauaugauacgacuuuauaugaagcguuuuauuugc

SEQ ID NO: 4251319 - RNA, 55 nt, Staphylococcus aureus subsp. aureus Mu50
ugaacaaccgggcagaaugaaaaucaaaacgauuuuuacucuguccgguuuuuua

SEQ ID NO: 4251320 - RNA, 80 nt, Staphylococcus aureus subsp. aureus Mu50
ccaaacaugacuaaagggcaggcauuaaaacgauuguuagauaaaugggaaaugucuccuucagagcucauggccuuugg

SEQ ID NO: 4251321 - RNA, 66 nt, Staphylococcus aureus subsp. aureus Mu50
gaaugguuaacacaugauuucaauauuauugauacaggugguauugaaauuggugaugcaccauuc

SEQ ID NO: 4251322 - RNA, 62 nt, Staphylococcus aureus subsp. aureus Mu50
uagauuuuauauaaaaagaagaucccucaaucgaggggucuuuuuuuaauguguaaauuuug

SEQ ID NO: 4251323 - RNA, 70 nt, Staphylococcus aureus subsp. aureus Mu50
acccaaaagggcauaaaaaucccagugauaaauacuuuuaucacugggauuuuuaugcauaaccauaggu

SEQ ID NO: 4251324 - RNA, 87 nt, Staphylococcus aureus subsp. aureus Mu50
gccuguccauuuaauuguacuuguggcacccaugaaaagccccacgccaaucguaccaccaagugcaaucauuugaauuugacgggc

SEQ ID NO: 4251325 - RNA, 60 nt, Staphylococcus aureus subsp. aureus Mu50
uaucgauggcuuuaaagauacgguaucaaacuacauaugaaccguuuaaaguaguugaug

SEQ ID NO: 4251326 - RNA, 115 nt, Staphylococcus aureus subsp. aureus Mu50
ugcuaaugacgaacgaaacaauugccagacguguauccaauuaaccgaaacaaagcuaauguaucguuuuaaauagauaaacaaagguaauugguuuaauaccgucacaauagca

SEQ ID NO: 4251327 - RNA, 55 nt, Staphylococcus aureus subsp. aureus Mu50
uaaaagccaaucaaacggaguguugaagucaacauuucccauugauuggcuuuua

SEQ ID NO: 4251328 - RNA, 89 nt, Staphylococcus aureus subsp. aureus Mu50
uuaccaaguaaagauaauuuggcuauauuguauggagaaggauuucauauuuguaaaggcgaauuauuuggaaaacaucgacaugguga

SEQ ID NO: 4251329 - RNA, 72 nt, Staphylococcus aureus subsp. aureus Mu50
gcaagaaaccaauguuaauuggaacaggaguucuuauugucggagaaugucucauuucauuaacuuucuugc

SEQ ID NO: 4251330 - RNA, 81 nt, Staphylococcus aureus subsp. aureus Mu50
guguugaaugcggcguugaagaagauaaugucuucaucuuugauauuggagaugucuuagcuuuaacacacgauucagcac

SEQ ID NO: 4251331 - RNA, 76 nt, Staphylococcus aureus subsp. aureus Mu50
cuaacuauaugagugauuuaaaugacgcuauguuacuuauuaaagguaauuuaaauuuagauccuguagaaguuag

SEQ ID NO: 4251332 - RNA, 101 nt, Staphylococcus aureus subsp. aureus Mu50
ugucgugcguuacaaguaaaugcugagcgaauauacauuuguucaauaccagcaucuguaauuuucuuagcaauuucagguguaauuaauucaucaggacg

SEQ ID NO: 4251333 - RNA, 87 nt, Staphylococcus aureus subsp. aureus Mu50
caugucccauauuauuuaucaaaugugcuucuacuuuccaaccuacaccuuuaugugacguagauugaucaaguaauguacgauaug

SEQ ID NO: 4251334 - RNA, 60 nt, Staphylococcus aureus subsp. aureus Mu50
gauuaggaguguggcagagaugaaauuuuuauaaaauucauuucugccacacuccuuuuu

SEQ ID NO: 4251335 - RNA, 89 nt, Staphylococcus aureus subsp. aureus Mu50
uguuuaaugcauucaauuggucgaugucauguuuaccauuuguuuuagcaagugcuacacguucaucaccauuuaaugcuuguuuugca

SEQ ID NO: 4251336 - RNA, 62 nt, Staphylococcus aureus subsp. aureus Mu50
ucaagguguaguuagugauuaucauauacauaaaaauaagauauuugcuaaaaauacuuuga

SEQ ID NO: 4251337 - RNA, 72 nt, Staphylococcus aureus subsp. aureus Mu50
gaacgaugacaccacugauuacaauacccauuauuucacgugcauuuggucccagugguguggguauuguuu

SEQ ID NO: 4251338 - RNA, 68 nt, Staphylococcus aureus subsp. aureus Mu50
ucuagugcauuauugauuugauaccuguaaaguugccauauuuccguuuagaaucaauagucgcuaga

SEQ ID NO: 4251339 - RNA, 68 nt, Staphylococcus aureus subsp. aureus Mu50
ucgcuuuauauacauuuuuaaauggcgaugaaucuaaugcaucaauauuuuuaauguguguacuguga

SEQ ID NO: 4251340 - RNA, 79 nt, Staphylococcus aureus subsp. aureus Mu50
gugaugccuuguuuaaucgcuuguugaccugcuuccaugauaacuggaccaucagcaaccggaucagagaaagguacac

SEQ ID NO: 4251341 - RNA, 96 nt, Staphylococcus aureus subsp. aureus Mu50
uguuaaaagaggagaguaaugguauuaaagcugaacuuccaaaucuugaagaagagcuuaaaauauuauugauuccuaaagauccuaaugaugaca

SEQ ID NO: 4251342 - RNA, 70 nt, Staphylococcus aureus subsp. aureus Mu50
guggcuacauucgaacauaucaaagcauacgauagaaaaacaauaaguuaugauauguuacauguaacac

SEQ ID NO: 4251343 - RNA, 120 nt, Staphylococcus aureus subsp. aureus Mu50
acucaaggguauaacacauaccucaacuuagcuaaacaacguuuuaaaugcuuagaaugcaauggcacuuuuacugcuaaaacgucaauuguugaugagucguguuuuaucucaagaugu

SEQ ID NO: 4251344 - RNA, 104 nt, Staphylococcus aureus subsp. aureus Mu50
uauucaauuuuuucaauaaugucgucuuuugcuuuuucaccuugaaccaaaguacuaauuuguauuuguucagcuaauggaaaacgacuauuuaucguugaaug

SEQ ID NO: 4251345 - RNA, 129 nt, Staphylococcus aureus subsp. aureus Mu50
aagcuucagcaguuaauucaguuguaauugguuuuccuaauaauugugaauaugcaaguaaacguguuaaugcaccuucuaauucacgaauauuagauugaauuugauuugcuauauaauuuaaagcuu

SEQ ID NO: 4251346 - RNA, 70 nt, Staphylococcus aureus subsp. aureus Mu50
uaugcugugaaguuauuaaaucauuugagacauaaugguauuaaagcagauaaagacuacuuacagcgua

SEQ ID NO: 4251347 - RNA, 72 nt, Staphylococcus aureus subsp. aureus Mu50
uaugaugagaaugauauacaccccaaaaguuggauugaaagaccuaacuuuaagggguguauuuuuguuaua

SEQ ID NO: 4251348 - RNA, 92 nt, Staphylococcus aureus subsp. aureus Mu50
auguauucuugauugaaucagaauagauuugaugcuucagcuguuuuuaaugaaaauagcauuaaaugauuuugaaaacgauaagagugugu

SEQ ID NO: 4251349 - RNA, 69 nt, Staphylococcus aureus subsp. aureus Mu50
uuuggucaaugauggaugaaauuaacgaagaagaagauuuuguuguagaagguccauuauggauucaag

SEQ ID NO: 4251350 - RNA, 63 nt, Staphylococcus aureus subsp. aureus Mu50
agaugauauuucaagauccguaugcaucauugaauccgaugcaaaugguuggagauaucauuu

SEQ ID NO: 4251351 - RNA, 70 nt, Staphylococcus aureus subsp. aureus Mu50
uacaccgaagaauugauaaccuucauuaagcauugccuuugcaauggguugugcaauuguuucauuugua

SEQ ID NO: 4251352 - RNA, 58 nt, Staphylococcus aureus subsp. aureus Mu50
gggauuauuaauuguacuuuggggacuuaacgggguguuccaaucaguugguggaccu

SEQ ID NO: 4251353 - RNA, 80 nt, Staphylococcus aureus subsp. aureus Mu50
augacaucaauaaaaagcgaccaguucgcaguuuacaauucguaacacugcaaaauuggucgcuuuauuuuguauguuau

SEQ ID NO: 4251354 - RNA, 72 nt, Staphylococcus aureus subsp. aureus Mu50
gcugguacagguuguuauguaucgauuucagaagauaaacgauauuuauuugaagcgguauauggugcuggc

SEQ ID NO: 4251355 - RNA, 78 nt, Staphylococcus aureus subsp. aureus Mu50
uuaaugagcgaguuaucauguuaauuacaaagcaacagcccauugcgagugauuugcguaugaugauuucuucauuaa

SEQ ID NO: 4251356 - RNA, 61 nt, Staphylococcus aureus subsp. aureus Mu50
uguuuuacgucaaagugccaauggaagaauuauuguaauuucaucaauuuggggugagaca

SEQ ID NO: 4251357 - RNA, 58 nt, Staphylococcus aureus subsp. aureus Mu50
uaaaacuccuaauguggaacuaguuaaaaaauucuaaacuaguacauuaggaguuuug

SEQ ID NO: 4251358 - RNA, 61 nt, Staphylococcus aureus subsp. aureus Mu50
aggagggagugggacagaaaugauauuuucgcaaaauuuauuucgucgucccaccccaacu

SEQ ID NO: 4251359 - RNA, 108 nt, Staphylococcus aureus subsp. aureus Mu50
gcuguuaacacuuucaacguaugcaacgugaccguaugcaccuugaguuguuugcauaauugcaccagcuuuugguguauuguucacuguguaaccagcucuugcagc

SEQ ID NO: 4251360 - RNA, 92 nt, Staphylococcus aureus subsp. aureus Mu50
uucauagcgcaauacaucaacauugaagucgcguaauugugaacguuucguauagcguuuuucaaaauggcuuaaugcuuugcguucaugga

SEQ ID NO: 4251361 - RNA, 96 nt, Staphylococcus aureus subsp. aureus Mu50
aaaccuuucucguuuugacggaauucguuaugguuaucauucuaaagaagcucauucauuagaagaauuauauaaaaugucaagaucugaagguuu

SEQ ID NO: 4251362 - RNA, 76 nt, Staphylococcus aureus subsp. aureus Mu50
ccaaauagcuguccauaucgucauaacuauugucauuaucgucgugaaaacaguugugaugauuguaacuaaaagg

SEQ ID NO: 4251363 - RNA, 79 nt, Staphylococcus aureus subsp. aureus Mu50
guuuugcaauguuacuagagaagauuuuaaaagaagaaaagccaaaucauuuuuuaguagcguuugaugcagguaaaac

SEQ ID NO: 4251364 - RNA, 57 nt, Staphylococcus aureus subsp. aureus Mu50
uguauugucagaaggugucauuaaaguaauggcuaagaugggaauuucgacagugca

SEQ ID NO: 4251365 - RNA, 55 nt, Staphylococcus aureus subsp. aureus Mu50
aucacguuugcauacaaauccgaugcgaauuuuggauuguaaaguugaccgugau

SEQ ID NO: 4251366 - RNA, 55 nt, Staphylococcus aureus subsp. aureus Mu50
gauuggauuaaagcagguuuagucguugcaaacgauaaaguuguuaaaucuaauu

SEQ ID NO: 4251367 - RNA, 101 nt, Staphylococcus aureus subsp. aureus Mu50
aaaaguacuaucuauuaaacauuuugauguguacgcuauaaguuagauauaucucuaacuuauuuagauacaggucaaugaaguuuauggauaguacuuuu

SEQ ID NO: 4251368 - RNA, 88 nt, Staphylococcus aureus subsp. aureus Mu50
ucguauaguaugucaagguuuugacuuauugcuuuauuucgcucuggaugugcaauaaucgguacaaagccuuuacucuguaauucga

SEQ ID NO: 4251369 - RNA, 64 nt, Staphylococcus aureus subsp. aureus Mu50
aaguaugcgucacaacguaaaucagcagucgguacuggugaucguucagaacguauucgaacuu

SEQ ID NO: 4251370 - RNA, 82 nt, Staphylococcus aureus subsp. aureus Mu50
auagauauguauugccugcaauaauuacagccggguugucagacagcuuacuuauuauuauugcagugguaggaguaucuau

SEQ ID NO: 4251371 - RNA, 77 nt, Staphylococcus aureus subsp. aureus Mu50
ucaguugcuguagauguuaaaaagcauaaaucaacaucagaugguuuauggucaugaauacuuugcaucagugcuga

SEQ ID NO: 4251372 - RNA, 112 nt, Staphylococcus aureus subsp. aureus Mu50
guaauaaauuugaagcagcuuaacgaugaaauguugaauaaauacguacauccuccaaaaaggggcguaucuaaaucaacagugucguuaggcuguuuuuauguuuuauaac

SEQ ID NO: 4251373 - RNA, 56 nt, Staphylococcus aureus subsp. aureus Mu50
ccagcguaugcacugcuuugucugccagcuaagaagaguucauuaccauauguugg

SEQ ID NO: 4251374 - RNA, 62 nt, Staphylococcus aureus subsp. aureus Mu50
gaguuaaguucgauugauuuagaagauaaagaaauugaaaucuucgguagucgagaugacuu

SEQ ID NO: 4251375 - RNA, 64 nt, Staphylococcus aureus subsp. aureus Mu50
uagcuaugaccauaugccauguuagcauaugcgcuaugauccacauugggcauaaucacagcua

SEQ ID NO: 4251376 - RNA, 71 nt, Staphylococcus aureus subsp. aureus Mu50
uuuaauaagccaguuuuaguuuugcgaagcguuacagaacguccugaagguguugaagcuggcacauuaaa

SEQ ID NO: 4251377 - RNA, 91 nt, Staphylococcus aureus subsp. aureus Mu50
uuggagguuguuguauguaugguggucuuacauuuaauaguucagaaaaugaaagagauaaauuaauuacuguacagguaacaaucgacaa

SEQ ID NO: 4251378 - RNA, 65 nt, Staphylococcus aureus subsp. aureus Mu50
ggugcucaugcaaagucuucgauacuuuguuacauacaaaguauuuuaacauuuguauuuguacc

SEQ ID NO: 4251379 - RNA, 73 nt, Staphylococcus aureus subsp. aureus Mu50
gaguuaauuggcgaugauaaaguagaugaaauugcacgaaugauuucaggugcaaguguuacugauuuaacuc

SEQ ID NO: 4251380 - RNA, 94 nt, Staphylococcus aureus subsp. aureus Mu50
uagaggugcuuugauuuuauugaagcaucaaauuaucccuuuuuucucagugggagacuuugauucagucaguaaagaagaacgccaacuucua

SEQ ID NO: 4251381 - RNA, 59 nt, Staphylococcus aureus subsp. aureus Mu50
cuuaugaagaugaacgcgugcuugauguuguaauuaaaggucacgaacgucuuuaugag

SEQ ID NO: 4251382 - RNA, 78 nt, Staphylococcus aureus subsp. aureus Mu50
gaaaguuaagaaauauucaauggggaugaagcaaaaguuagcaauugcaguaucuuuaaugaauaaaccuaaauuuuu

SEQ ID NO: 4251383 - RNA, 60 nt, Staphylococcus aureus subsp. aureus Mu50
aucauucaaaccuaaguaagcuuccguuuccacgauguagccuguauacguuugaguggu

SEQ ID NO: 4251384 - RNA, 108 nt, Staphylococcus aureus subsp. aureus Mu50
uugagaugucacguuaaugauuauauuguuuauucauuugcuuuauuauggggacaauucgcauguaaaccaccuaugaaagaacaagaaaucaacgcuacuuuucaa

SEQ ID NO: 4251385 - RNA, 61 nt, Staphylococcus aureus subsp. aureus Mu50
aauucuacaucaauccuacaggacgcuuuguaaucgguggaccucaaggugaugcaggauu

SEQ ID NO: 4251386 - RNA, 59 nt, Staphylococcus aureus subsp. aureus Mu50
ucaucaacguuuuauggcacagcuugauuuuggcggugugccauuugaaaauguuauga

SEQ ID NO: 4251387 - RNA, 85 nt, Staphylococcus aureus subsp. aureus Mu50
ggcaucaagucagucguaucugguuauaguggcggucauguugauaacccuacuuaugaacagguauguacgaauaaaaccggcc

SEQ ID NO: 4251388 - RNA, 84 nt, Staphylococcus aureus subsp. aureus Mu50
uugaucuuauuaaugauacauuagugucgauucguuuuagugugaaucaaaacguucauuuugaaguguuguuaguaaaauuag

SEQ ID NO: 4251389 - RNA, 60 nt, Staphylococcus aureus subsp. aureus Mu50
augaaucauauaagcacuacugcuguuguaaagauggcaguaguuuuuuuaugauuacau

SEQ ID NO: 4251390 - RNA, 65 nt, Staphylococcus aureus subsp. aureus Mu50
uuguuauguugauguguagccuaaaauauuggagauaccaauauuuuagguugcaucaacaucaa

SEQ ID NO: 4251391 - RNA, 55 nt, Staphylococcus aureus subsp. aureus Mu50
ugggagugggacagaaaugauauuuucguaaaauuuauuucgucgucccacccca

SEQ ID NO: 4251392 - RNA, 75 nt, Staphylococcus aureus subsp. aureus Mu50
gaaaauggcuauggcaaaagcccaaugguagcauucaugcaacauugcaaacguggguuugguauagucauauuc

SEQ ID NO: 4251393 - RNA, 73 nt, Staphylococcus aureus subsp. aureus Mu50
cgucauuucucuagcacuauguucuuguuucugaccgaaacuuuuuaaagaaauuggacuuggugcuacgacg

SEQ ID NO: 4251394 - RNA, 74 nt, Staphylococcus aureus subsp. aureus Mu50
agagaacucuaaguugaguuaauaagggugguaccgcgagcaaucgucccuuuuaauuuaacuuagaguuuuuu

SEQ ID NO: 4251395 - RNA, 78 nt, Staphylococcus aureus subsp. aureus Mu50
cgaaaucuuuagacaaguauccuacugaaaaucuagaagaguuuuaugauaaagaaggauauagagauggagaauuug

SEQ ID NO: 4251396 - RNA, 76 nt, Staphylococcus aureus subsp. aureus Mu50
ggucugguuuaacaauagguguggcuuuuguagggauuuucuuagucaucgauuuauuaguuaaaaauuuagggcc

SEQ ID NO: 4251397 - RNA, 67 nt, Staphylococcus aureus subsp. aureus Mu50
uauaaauagagaacagcaguaagacgauuucaaugagaagcugucuuacugcuguuuuuagguuaua

SEQ ID NO: 4251398 - RNA, 81 nt, Staphylococcus aureus subsp. aureus Mu50
gauuugcuucucaacuaacucccauugugcaagcucugacaacuuaagacuuaaagcacgugguguuauuguuuucaaauc

SEQ ID NO: 4251399 - RNA, 104 nt, Staphylococcus aureus subsp. aureus Mu50
gguucgauugagcaagaugccgauaucguugcauucuuauaccgugaugauuacuauaaccguggcggcgaugaagaugaugacgaugauggugguuucgagcc

SEQ ID NO: 4251400 - RNA, 86 nt, Staphylococcus aureus subsp. aureus Mu50
guaauaauuuauaaaaauaacccguccaacuauguaugugaugaugcauacauguguuggcggguuuguuuuuauuggucuucuac

SEQ ID NO: 4251401 - RNA, 65 nt, Staphylococcus aureus subsp. aureus Mu50
auguacugaacaauaaauggguaugggcaauugccuuugcaaauauauuuguuuauuucgugcgu

SEQ ID NO: 4251402 - RNA, 102 nt, Staphylococcus aureus subsp. aureus Mu50
guuuaguuuaaaugaaaugcacuauuuaaguuuuuaauauggagauguuugugacuuuucgaugauuaagauuuuuauaggugugcaucauuucaaauaaac

SEQ ID NO: 4251403 - RNA, 62 nt, Staphylococcus aureus subsp. aureus Mu50
uucaaggauaacggauaauacuauuguaaucuuuaaagguauuaaucugcuuaauucuugaa

SEQ ID NO: 4251404 - RNA, 70 nt, Staphylococcus aureus subsp. aureus Mu50
uucauaaaggcacgcauacuuuguagucaguuaucuguucugacauauaaagcgugcgugcuuuuuugaa

SEQ ID NO: 4251405 - RNA, 119 nt, Staphylococcus aureus subsp. aureus Mu50
agccaaccauucaagauacugaacauuaauaaaacccuuagcuagauugaaaaugggaaucaugcaauucaagcauggaccuguaaucuaguuagggguuuuuaucuuuaaugaagguu

SEQ ID NO: 4251406 - RNA, 70 nt, Staphylococcus aureus subsp. aureus Mu50
gaugccuauaaugcaaguccuacaaguaugagagcagcuauugauacacuggguacuuugacagggcguc

SEQ ID NO: 4251407 - RNA, 90 nt, Staphylococcus aureus subsp. aureus Mu50
gauugaaagccuauuuuaaugaaaugacuuaugaugauaaguugcgacagcaaauuaaagaugaguuauuaaauuuagaugaacuugauc

SEQ ID NO: 4251408 - RNA, 91 nt, Staphylococcus aureus subsp. aureus Mu50
agcaccaauugcgacggauccuugugcaauuuuauuaaaacgaacgauuuguucuuuauaaaaacuugucacaagaacgcggucaaaugcu

SEQ ID NO: 4251409 - RNA, 64 nt, Staphylococcus aureus subsp. aureus Mu50
cgcuguuuauauugguagcaucuuugguauaauaacuuugauagggauguuuuuauuaacagcg

SEQ ID NO: 4251410 - RNA, 79 nt, Staphylococcus aureus subsp. aureus Mu50
uuugguuuaacuuauaaaggugauguugaugauauaagagaaucgccagcauuugauauuuaugagcuauuaaaucaag

SEQ ID NO: 4251411 - RNA, 93 nt, Staphylococcus aureus subsp. aureus Mu50
gguaucuguacuaucauuauuaguaaucgcgucauuuguaguggcauuugguccgcaaguaggugcaauuauuuucuaugguagugcgauauu

SEQ ID NO: 4251412 - RNA, 57 nt, Staphylococcus aureus subsp. aureus Mu50
gaccauuauucugugaagguaaagggcaauuccgcuuugcugcguugaguggugauc

SEQ ID NO: 4251413 - RNA, 82 nt, Staphylococcus aureus subsp. aureus Mu50
ucaaucacuguaaauaacaaugugaugauuagugaugcccacagcgucuuuuuagaacuuuguugaauuuuuugaugauuga

SEQ ID NO: 4251414 - RNA, 56 nt, Staphylococcus aureus subsp. aureus Mu50
aaaccuacaauaguagauucuguacauaauggcagaaaauuuacuauugcagguuu

SEQ ID NO: 4251415 - RNA, 60 nt, Staphylococcus aureus subsp. aureus Mu50
guuuguguuauuuuucuuaaugaaauuugcgcaugucaugacaccugaaaugacacaagc

SEQ ID NO: 4251416 - RNA, 71 nt, Staphylococcus aureus subsp. aureus Mu50
gucauauuaauguuuaucguugguguuuggaugcacaaacguucaaaugcgaaacgcuggaaugauaugau

SEQ ID NO: 4251417 - RNA, 85 nt, Staphylococcus aureus subsp. aureus MW2
gcaaucgcacuaggauauacauuuaaaacagcgauuaacccuuauauuucgacuuuuuuagguguguuauuaacaguaguggugc

SEQ ID NO: 4251418 - RNA, 59 nt, Staphylococcus aureus subsp. aureus MW2; identical to SEQ ID NO: 4250870

SEQ ID NO: 4251419 - RNA, 81 nt, Staphylococcus aureus subsp. aureus MW2
gcugagaauauaaaugcuaauaaaauaaguguugucaucaaaacgguaacaauauuaaauuggucuuuauauugauugagu

SEQ ID NO: 4251420 - RNA, 62 nt, Staphylococcus aureus subsp. aureus MW2
ugaauucuucacccauuguuacaccugaauauggugcaauauauaauaauggagaagguuca

SEQ ID NO: 4251421 - RNA, 69 nt, Staphylococcus aureus subsp. aureus MW2
agaaagucaugagaugaagugaacggauguauagaugaucguucacucacacauuagucaugauuuccu

SEQ ID NO: 4251422 - RNA, 66 nt, Staphylococcus aureus subsp. aureus MW2
ugaucaugcauuugaguguguggguggucgcgguagucaaucagccauaaaucaaaugaucgauua

SEQ ID NO: 4251423 - RNA, 88 nt, Staphylococcus aureus subsp. aureus MW2
ucauggaauacaaacaacauccuuucaaaguauuuacaauuagugugaauuacuuugaagggauuguuuuuuguggaaaaauuuauga

SEQ ID NO: 4251424 - RNA, 58 nt, Staphylococcus aureus subsp. aureus MW2
aaagcacucauuauuuaaggcgcaucauuacgugggucauugaaauaaugaguguuuu

SEQ ID NO: 4251425 - RNA, 62 nt, Staphylococcus aureus subsp. aureus MW2; identical to SEQ ID NO: 4250900

SEQ ID NO: 4251426 - RNA, 68 nt, Staphylococcus aureus subsp. aureus MW2; identical to SEQ ID NO: 4251282

SEQ ID NO: 4251427 - RNA, 64 nt, Staphylococcus aureus subsp. aureus MW2; identical to SEQ ID NO: 4251066

SEQ ID NO: 4251428 - RNA, 71 nt, Staphylococcus aureus subsp. aureus MW2; identical to SEQ ID NO: 4251376

SEQ ID NO: 4251429 - RNA, 76 nt, Staphylococcus aureus subsp. aureus MW2; identical to SEQ ID NO: 4250917

SEQ ID NO: 4251430 - RNA, 65 nt, Staphylococcus aureus subsp. aureus MW2
aggcaucgacuucaucaauaaaaauaguaucaaagugcuguuugaaucgguaaaguugaugcacu

SEQ ID NO: 4251431 - RNA, 108 nt, Staphylococcus aureus subsp. aureus MW2
gauaaugucauuuuuaauugagcuaaacagacaagggaagacgauuauuaugauuacgcaugauaugcauuuauugucugaguauaguucaagaacaguuguauuauc

SEQ ID NO: 4251432 - RNA, 70 nt, Staphylococcus aureus subsp. aureus MW2
cuuugcucacugaaggaucgucuuuaaggcuuuggaugaagccguuacguuguucuucaguuaaguuagg

SEQ ID NO: 4251433 - RNA, 96 nt, Staphylococcus aureus subsp. aureus MW2; identical to SEQ ID NO: 4251206

SEQ ID NO: 4251434 - RNA, 63 nt, Staphylococcus aureus subsp. aureus MW2
ucuaauacugcaacugcaacgaugauuuuaccgauuuuagcaacguugucuguugcuguugga

SEQ ID NO: 4251435 - RNA, 88 nt, Staphylococcus aureus subsp. aureus MW2
agcagaaguaucacauccaaguaaacaaggucuaguacaagcauuuucaguuuauauugauacauuauuuguauguacugcaacugcu

SEQ ID NO: 4251436 - RNA, 74 nt, Staphylococcus aureus subsp. aureus MW2; identical to SEQ ID NO: 4251011

SEQ ID NO: 4251437 - RNA, 60 nt, Staphylococcus aureus subsp. aureus MW2
gaucaugguaggcaaauguaccacauguuaaaaauacauaaucguacgcuugccaugauu

SEQ ID NO: 4251438 - RNA, 81 nt, Staphylococcus aureus subsp. aureus MW2; identical to SEQ ID NO: 4251240

SEQ ID NO: 4251439 - RNA, 97 nt, Staphylococcus aureus subsp. aureus MW2; identical to SEQ ID NO: 4250708

SEQ ID NO: 4251440 - RNA, 86 nt, Staphylococcus aureus subsp. aureus MW2
uuaaguuuccaauuuaauaaagauguggcuuguguuaauuuuaaagauaagcaagcaguagugacauuuuuauuagagcaauuuga

SEQ ID NO: 4251441 - RNA, 56 nt, Staphylococcus aureus subsp. aureus MW2
uuaaucauguuuagugucuucuuugcguuuguauuccaagaagaugucaugauuaa

SEQ ID NO: 4251442 - RNA, 71 nt, Staphylococcus aureus subsp. aureus MW2; identical to SEQ ID NO: 4251254

SEQ ID NO: 4251443 - RNA, 57 nt, Staphylococcus aureus subsp. aureus MW2
gcacagauauuuuuacaaugagaagcgauacagcugccucaauaaaaauauuugugc

SEQ ID NO: 4251444 - RNA, 76 nt, Staphylococcus aureus subsp. aureus MW2
gcaaaaaggugcuggcgaaaagaaaguuaauuacaaauuaagagauugguuauucagucgucagcguuauuggggc

SEQ ID NO: 4251445 - RNA, 60 nt, Staphylococcus aureus subsp. aureus MW2
gcagauggcuauuuacgcauaaugcaagguagcuuuguaaauguaaauggucaucaaugc

SEQ ID NO: 4251446 - RNA, 59 nt, Staphylococcus aureus subsp. aureus MW2
ucccuauacuuuaucuguaucacuacguuauucgugaugaugcauuaagaguauaggga

SEQ ID NO: 4251447 - RNA, 77 nt, Staphylococcus aureus subsp. aureus MW2; identical to SEQ ID NO: 4251243

SEQ ID NO: 4251448 - RNA, 62 nt, Staphylococcus aureus subsp. aureus MW2
aguagggauugggacagaaauguuauuuucacaaaauucauuucguugacccacuuccugcu

SEQ ID NO: 4251449 - RNA, 55 nt, Staphylococcus aureus subsp. aureus MW2
gugaaaugcuuggauugauggcacaauuccuucuaucguuucaagucguuucugc

SEQ ID NO: 4251450 - RNA, 104 nt, Staphylococcus aureus subsp. aureus MW2
gagaaucguggcuuuguuugcgauagucucgaugguauuguucuuuuucaucugaaauaguaucugcagauuguucaacauuuucauuuucauaagcuacgcuc

SEQ ID NO: 4251451 - RNA, 92 nt, Staphylococcus aureus subsp. aureus MW2
cgaugaugagugaguucuuugauuuaccagguguaucgauugcuacaggaaguacaauuucuuaugcaccagguauuuacuuaguuaaauug

SEQ ID NO: 4251452 - RNA, 103 nt, Staphylococcus aureus subsp. aureus MW2; identical to SEQ ID NO: 4251015

SEQ ID NO: 4251453 - RNA, 86 nt, Staphylococcus aureus subsp. aureus MW2; identical to SEQ ID NO: 4251000

SEQ ID NO: 4251454 - RNA, 59 nt, Staphylococcus aureus subsp. aureus MW2
cugaagguaacuuauuaagcaaugaaguuagcccuaauugugacauaaguugcugauag

SEQ ID NO: 4251455 - RNA, 85 nt, Staphylococcus aureus subsp. aureus MW2
guauuugguuuaacuuauaaaggugauguugaugauauaagagaaucgccagcauuugauauuuaugagcuauuaaaucaagaac

SEQ ID NO: 4251456 - RNA, 63 nt, Staphylococcus aureus subsp. aureus MW2
cugccucaaguaguaacguaguacguccaucauuuaagacguagcaguuaccacuugaaccag

SEQ ID NO: 4251457 - RNA, 83 nt, Staphylococcus aureus subsp. aureus MW2
aaaaagcacuaucauaagacgguaaauaucaauugcguauuauuaaacgacaauugaaguacacguuuauggcagugcuuuuu

SEQ ID NO: 4251458 - RNA, 72 nt, Staphylococcus aureus subsp. aureus MW2
agaaucgucugcacuuaguugaacaaauucuaugagaauagauauuguuaaacuauguggauaggugauuuu

SEQ ID NO: 4251459 - RNA, 116 nt, Staphylococcus aureus subsp. aureus MW2
uugcgagcuacaauuuuaaggguuaugauuuuuaagugauaaugauuauuauuucuaauaggagagcgaaauaguauguuaaacauuaaaaauggugaaaugaauaaggcuuauaa

SEQ ID NO: 4251460 - RNA, 79 nt, Staphylococcus aureus subsp. aureus MW2
cugugucugaguucacuguuguauuaaacaucacuucuaauucaucuuuauuagguuuaauaaauaguggaugauaugg

SEQ ID NO: 4251461 - RNA, 59 nt, Staphylococcus aureus subsp. aureus MW2
acagcuguuaaaauggcauagauggguguuaaaucuagugccauacaaaagacagcugu

SEQ ID NO: 4251462 - RNA, 89 nt, Staphylococcus aureus subsp. aureus MW2
guauuaguaguuacugaaaaugguuaugguaaacguacgccaguuaaugacuaucguuuaucaaaucguggugguaaagguauuaaaac

SEQ ID NO: 4251463 - RNA, 66 nt, Staphylococcus aureus subsp. aureus MW2
uaaaugaaucauauaagcacuacugcuguuguaaagauggcaguaguuuuuuuaugauuacaucua

SEQ ID NO: 4251464 - RNA, 79 nt, Staphylococcus aureus subsp. aureus MW2
aaacgucaguuauuaacaugauuacgaugaacauuauugaaacuguucauagucuucugucaugugauagcugacguuu

SEQ ID NO: 4251465 - RNA, 72 nt, Staphylococcus aureus subsp. aureus MW2; identical to SEQ ID NO: 4251337

SEQ ID NO: 4251466 - RNA, 68 nt, Staphylococcus aureus subsp. aureus MW2
auaacaaaagacacaucuauacgaugaucauuuacaaugauugcguauagugaugugucuuuuuuugu

SEQ ID NO: 4251467 - RNA, 69 nt, Staphylococcus aureus subsp. aureus MW2
uucauaaaggcacgcauacuuuguagucaguuaucuguucugacauauaaagcgugcgugcuuuuuggg

SEQ ID NO: 4251468 - RNA, 64 nt, Staphylococcus aureus subsp. aureus MW2
gugaaggugguaacaacguuauuaaauuaaguacaggugaugacguuguugaauuaucuucuac

SEQ ID NO: 4251469 - RNA, 61 nt, Staphylococcus aureus subsp. aureus MW2
ugaugcaugcgcuaggcgucgauuuuucagaaauugaggcagaauuagcgcguagacauca

SEQ ID NO: 4251470 - RNA, 82 nt, Staphylococcus aureus subsp. aureus MW2
accaugugugucuaacgaauugucuuuuguugcguaaacuacuuuaguuaucuuacaaucaauaauuuuguuaacacagggu

SEQ ID NO: 4251471 - RNA, 69 nt, Staphylococcus aureus subsp. aureus MW2; identical to SEQ ID NO: 4250742

SEQ ID NO: 4251472 - RNA, 106 nt, Staphylococcus aureus subsp. aureus MW2
guugugcugcaggauuagcuugagcaccagcauuugcguuaggcugugcauuggcaucagcugguugugcugguugauuuugugcaggcugauuuugcucugcugc

SEQ ID NO: 4251473 - RNA, 56 nt, Staphylococcus aureus subsp. aureus MW2
aucaagcuguagaaaugguuucacgugcaauucgccguaaucgugcuggguuugau

SEQ ID NO: 4251474 - RNA, 55 nt, Staphylococcus aureus subsp. aureus MW2; identical to SEQ ID NO: 4250801

SEQ ID NO: 4251475 - RNA, 70 nt, Staphylococcus aureus subsp. aureus MW2
auauccaguguaauguguuuugcauauaugaaagcaauuucaaaaugugaauauagguucauugugguau

SEQ ID NO: 4251476 - RNA, 78 nt, Staphylococcus aureus subsp. aureus MW2
caaaagcauuuaguaagaaauuuguuccugucguaauggcggcuucaguagcauuauucuucuuaaacuuagcuuuug

SEQ ID NO: 4251477 - RNA, 55 nt, Staphylococcus aureus subsp. aureus MW2
uacaaagccuuaauaucaugcgcaauauucguagcaugacauuaaggcuuuagua

SEQ ID NO: 4251478 - RNA, 97 nt, Staphylococcus aureus subsp. aureus MW2
ucauugauacuguauauaaagaucaacauuuuacaauguuugaaacggacgcugaauuauucggauauuguuaugguguugcugguacaguagguga

SEQ ID NO: 4251479 - RNA, 73 nt, Staphylococcus aureus subsp. aureus MW2
uaugguaugggagauauugguaaagcuuuugcaagaagguugcaaggguuuaauacuaauauucuuuaucaua

SEQ ID NO: 4251480 - RNA, 55 nt, Staphylococcus aureus subsp. aureus MW2
ugcaugucagucauagaaaagauuugaaguucaacuuguaugugacgacauugca

SEQ ID NO: 4251481 - RNA, 98 nt, Staphylococcus aureus subsp. aureus MW2
aauguagauguucuuuagacauuaaaagcuucuaacaugauauggaauccgagguuccgauaucacauuagaagcuuuuuuguugcggugcuuauauu

SEQ ID NO: 4251482 - RNA, 102 nt, Staphylococcus aureus subsp. aureus MW2
uugcgauuaguuauuuagagaagcuagauguuacaaauauuaaagaagcauuagaaacguuuggugguguuaaacgucguuucaaugaaacuacaauugcaa

SEQ ID NO: 4251483 - RNA, 89 nt, Staphylococcus aureus subsp. aureus MW2; identical to SEQ ID NO: 4250719

SEQ ID NO: 4251484 - RNA, 65 nt, Staphylococcus aureus subsp. aureus MW2; identical to SEQ ID NO: 4250821

SEQ ID NO: 4251485 - RNA, 100 nt, Staphylococcus aureus subsp. aureus MW2; identical to SEQ ID NO: 4250951

SEQ ID NO: 4251486 - RNA, 68 nt, Staphylococcus aureus subsp. aureus MW2
uauacagauggcuuucaguagaguaguggauucggauucacgaacuauacuggaagcuuuuuauuaua

SEQ ID NO: 4251487 - RNA, 66 nt, Staphylococcus aureus subsp. aureus MW2
gucccaggugaggcuguucaacuuguuaaauuugaugauuauuggcaagguaagccugcauuagac

SEQ ID NO: 4251488 - RNA, 63 nt, Staphylococcus aureus subsp. aureus MW2
uuguaugaaaaggacaaccuugcggcggauuacuuggcgaagguaauucuccuuuuaauauaa

SEQ ID NO: 4251489 - RNA, 74 nt, Staphylococcus aureus subsp. aureus MW2
ugugauauauaaaauucgcuuguuccguggcuuuuuucaaagccucaggauuaaguaauuggaauauaacgaca

SEQ ID NO: 4251490 - RNA, 74 nt, Staphylococcus aureus subsp. aureus MW2
guauugguauuguauuauggguuauaggcuugcauccauuugcagucuucuuuccuauaaucgcuuuacuaauc

SEQ ID NO: 4251491 - RNA, 59 nt, Staphylococcus aureus subsp. aureus MW2
uuaacgaugcgaacaauuuuaacguugaaagguuaucguuauauugcugcaucaguuag

SEQ ID NO: 4251492 - RNA, 70 nt, Staphylococcus aureus subsp. aureus MW2; identical to SEQ ID NO: 4251198

SEQ ID NO: 4251493 - RNA, 106 nt, Staphylococcus aureus subsp. aureus MW2; identical to SEQ ID NO: 4251139

SEQ ID NO: 4251494 - RNA, 73 nt, Staphylococcus aureus subsp. aureus MW2
auguaguuuuagacacgguaacauuuuaugucaaguaagugacuauagaauguauggugucaaugacagacau

SEQ ID NO: 4251495 - RNA, 84 nt, Staphylococcus aureus subsp. aureus MW2; identical to SEQ ID NO: 4251316

SEQ ID NO: 4251496 - RNA, 67 nt, Staphylococcus aureus subsp. aureus MW2; identical to SEQ ID NO: 4251227

SEQ ID NO: 4251497 - RNA, 87 nt, Staphylococcus aureus subsp. aureus MW2
ugguuuacaucauauuuucuauucaccguucugguuugaauucggaaguuauacaaaucacgcaggugaauugguucguggugacca

SEQ ID NO: 4251498 - RNA, 81 nt, Staphylococcus aureus subsp. aureus MW2
gcauuguuaccuauuggauaugcagauggcuauuuacgcauaaugcaagguagcuuuguaaauguaaauggucaucaaugc

SEQ ID NO: 4251499 - RNA, 58 nt, Staphylococcus aureus subsp. aureus MW2
guacuugagcagguuuguaugcuacauuaacugucuuagcuacugcuugcuuaggugc

SEQ ID NO: 4251500 - RNA, 80 nt, Staphylococcus aureus subsp. aureus MW2; identical to SEQ ID NO: 4250706

SEQ ID NO: 4251501 - RNA, 92 nt, Staphylococcus aureus subsp. aureus MW2
uaaucgaauaacauacaaaauaaagcgaccaauuuugcaguguuacgaauuguaaacugcgaacuggucgcuuuuuauugaugucaugauua

SEQ ID NO: 4251502 - RNA, 65 nt, Staphylococcus aureus subsp. aureus MW2
aagcacagccaugauauacgaauguugcauguuauaugcuaaaccuucauaucauagcuguguuu

SEQ ID NO: 4251503 - RNA, 77 nt, Staphylococcus aureus subsp. aureus MW2
aauaauguaaagguuaauaucgguggugcaucagaugauauuaacaaugcaaugacacaauuagccuuugcaauguu

SEQ ID NO: 4251504 - RNA, 59 nt, Staphylococcus aureus subsp. aureus MW2
uagauaaucuucaagccacuuugucguuucuaaaucuaagugguuaguagguucaucua

SEQ ID NO: 4251505 - RNA, 71 nt, Staphylococcus aureus subsp. aureus MW2
aaagaauauuguaaugaugcaugcuguaaaugaauaaauucagauuuagcuucaucaauugugaguucuuu

SEQ ID NO: 4251506 - RNA, 129 nt, Staphylococcus aureus subsp. aureus MW2
gcaccuuuguuaauuaaaucguauaguaugucaagguuuugacuuauugcuuuauuccgcucuggaugugcaauaaucgguacaaagccuuuacucuguaauucgaaaaauaauugaucaguauagugu

SEQ ID NO: 4251507 - RNA, 113 nt, Staphylococcus aureus subsp. aureus MW2; identical to SEQ ID NO: 4251032

SEQ ID NO: 4251508 - RNA, 81 nt, Staphylococcus aureus subsp. aureus MW2
uugucugauuuaaauaaauaggagucaaaauaagaggagggcauuuuuuuaggugagaaaauauuuaucugaacuagauaa

SEQ ID NO: 4251509 - RNA, 101 nt, Staphylococcus aureus subsp. aureus MW2
ucgacuuugguacagugagaccaaugcaaauaggucuagucuacgacgcauuaaacucagagaaguuagacguugcauuagguuauucuacagauggucga

SEQ ID NO: 4251510 - RNA, 92 nt, Staphylococcus aureus subsp. aureus MW2
gccguuucagaacgucguacacaaguuguagcugauguccaucaauucgaaggacauaucgcuugugaugcuaauaguaagucugagauugu

SEQ ID NO: 4251511 - RNA, 63 nt, Staphylococcus aureus subsp. aureus MW2
agugauagaagagaaggccacacgcuuggaaucuuaaaccaagguguggcccuuuuuauuauu

SEQ ID NO: 4251512 - RNA, 85 nt, Staphylococcus aureus subsp. aureus MW2
accauuguucuauuucgguaacauuaugaaaccauugauuuggcugaugaaugguucugcacguguuauuauuagaauguuuggu

SEQ ID NO: 4251513 - RNA, 63 nt, Staphylococcus aureus subsp. aureus MW2; identical to SEQ ID NO: 4250714

SEQ ID NO: 4251514 - RNA, 124 nt, Staphylococcus aureus subsp. aureus MW2; identical to SEQ ID NO: 4251266

SEQ ID NO: 4251515 - RNA, 69 nt, Staphylococcus aureus subsp. aureus MW2; identical to SEQ ID NO: 4251349

SEQ ID NO: 4251516 - RNA, 90 nt, Staphylococcus aureus subsp. aureus MW2
uguugaccgugauguuugggcaagaucucguggcuuaauuucuucugaagaaauggcuaaagaacuuguugaauuaucaaaaaaagaaca

SEQ ID NO: 4251517 - RNA, 115 nt, Staphylococcus aureus subsp. aureus MW2; identical to SEQ ID NO: 4251326

SEQ ID NO: 4251518 - RNA, 60 nt, Staphylococcus aureus subsp. aureus MW2
uuuuuccauauacugguguaguugcuuuuaaaagugcaacuggauuuguaguuggaaaga

SEQ ID NO: 4251519 - RNA, 66 nt, Staphylococcus aureus subsp. aureus MW2
guaugguacguuuguaaaaacaggugcugauggaacuacagcaaagguuggaacaaacauaccaac

SEQ ID NO: 4251520 - RNA, 63 nt, Staphylococcus aureus subsp. aureus MW2
cugguucaagugguaacugcuacgucuuaaaugauggacguacuacguuacuacuugaggcag

SEQ ID NO: 4251521 - RNA, 74 nt, Staphylococcus aureus subsp. aureus MW2; identical to SEQ ID NO: 4251113

SEQ ID NO: 4251522 - RNA, 55 nt, Staphylococcus aureus subsp. aureus MW2; identical to SEQ ID NO: 4251292

SEQ ID NO: 4251523 - RNA, 69 nt, Staphylococcus aureus subsp. aureus MW2
ugaugcgcuuaauugcgucauugucuugcgccacaucucucaauuguaguaacgcucuuaaguguguca

SEQ ID NO: 4251524 - RNA, 63 nt, Staphylococcus aureus subsp. aureus MW2; identical to SEQ ID NO: 4251350

SEQ ID NO: 4251525 - RNA, 59 nt, Staphylococcus aureus subsp. aureus MW2; identical to SEQ ID NO: 4251115

SEQ ID NO: 4251526 - RNA, 79 nt, Staphylococcus aureus subsp. aureus MW2
uuagucaaacuuugaauuguacugucgacauaaucauagucaaauugauguugauguauguaauuuguuguuugacuga

SEQ ID NO: 4251527 - RNA, 84 nt, Staphylococcus aureus subsp. aureus MW2
uucuuuacauugguuaaaugggaaauuucuggcacguuaaauuauaugaagccuagagaguucuguuuaguuacaguguuggaa

SEQ ID NO: 4251528 - RNA, 64 nt, Staphylococcus aureus subsp. aureus MW2
ugauacugaaauaucaauauuggagauggggaugucagguuuccaugaaauugaauuucuguca

SEQ ID NO: 4251529 - RNA, 73 nt, Staphylococcus aureus subsp. aureus MW2
ucauuugugcaauuggaaaugguuuagucgcaacacccggccuuacaauugcaauuuucaguaugccaaauga

SEQ ID NO: 4251530 - RNA, 68 nt, Staphylococcus aureus subsp. aureus MW2
gcuugauagcauugcuuuaguagcgccugaacauauuguuagagcagcugcuagagaugcaguaaagc

SEQ ID NO: 4251531 - RNA, 117 nt, Staphylococcus aureus subsp. aureus MW2
ggauaaagaaaaaggugcuuuaaaacaguuggcuacaaacgaagguuaugaaacguuuaucguaccugaugauguagguggaagauauucuguuuuaacagcaguaggauuauuacc

SEQ ID NO: 4251532 - RNA, 76 nt, Staphylococcus aureus subsp. aureus MW2
uacuugaacagcgcuaacaaauaaaaucacagcaaagauuaagcuaauugaaauagauuguugugcuuguuuagua

SEQ ID NO: 4251533 - RNA, 107 nt, Staphylococcus aureus subsp. aureus MW2
gggauuauuggcguuauuuuugccguuuggauuuuaaguauugucgaaaagagauuacauaaaauugugccaaaugcgauugauauuauuguaacgccgacuauugc

SEQ ID NO: 4251534 - RNA, 59 nt, Staphylococcus aureus subsp. aureus MW2
acgacaccauuacaguuuguacuugugagguuauugcagggacuauuuggugguguugu

SEQ ID NO: 4251535 - RNA, 73 nt, Staphylococcus aureus subsp. aureus MW2
aggauaggaauaaugagugcgaauauuaacgguaauaucaccgcaauauguaacaaacucacuauguuguccu

SEQ ID NO: 4251536 - RNA, 76 nt, Staphylococcus aureus subsp. aureus MW2
uucuuaaaaguuuuaaugcagguucuaauuuuguuucaaccucuugauauaaugcaacgugcauagcaguugggaa

SEQ ID NO: 4251537 - RNA, 79 nt, Staphylococcus aureus subsp. aureus MW2; identical to SEQ ID NO: 4250964

SEQ ID NO: 4251538 - RNA, 62 nt, Staphylococcus aureus subsp. aureus MW2
uuauaaggagugagugacgaugaaaagguuaagcauaaucgucaucauuggaaucuuuauaa

SEQ ID NO: 4251539 - RNA, 79 nt, Staphylococcus aureus subsp. aureus MW2
uaguguaguucccauaacaauucguaucagacuuuuagacaaaacgagauagacacuaauugcugugagaauaccacua

SEQ ID NO: 4251540 - RNA, 71 nt, Staphylococcus aureus subsp. aureus MW2
agaguuuuaucaggugucgccauagguauuguugcggguuuaguuccuaaugcgauacuuggagaaauuuu

SEQ ID NO: 4251541 - RNA, 66 nt, Staphylococcus aureus subsp. aureus MW2
auuuaucaaucguugaaggugaucugagugauaauguuaguuugcaaucagcgaugaaagguaagu

SEQ ID NO: 4251542 - RNA, 76 nt, Staphylococcus aureus subsp. aureus MW2
gauuuaaauauaacaacgccacauaagauauaauuugguguuacgcaucuuauguggcguuggucguuauuugauu

SEQ ID NO: 4251543 - RNA, 73 nt, Staphylococcus aureus subsp. aureus MW2
auuguuaucucaucauuaugcucaaauaagugcucugauaauguuacuuuagcauggugugcgguuugacgau

SEQ ID NO: 4251544 - RNA, 87 nt, Staphylococcus aureus subsp. aureus MW2
acgaugaauacguaugaaauaagcgggauucaaucguuuuucauaacgauucaauggcucuguuguuucguauuuaugauucguugu

SEQ ID NO: 4251545 - RNA, 87 nt, Staphylococcus aureus subsp. aureus MW2
cuuuucaucaagggcuauuggagguauuguuccauccacuacuucaucaagcauggagauaucuuuaaauggcucuucgauauaaag

SEQ ID NO: 4251546 - RNA, 57 nt, Staphylococcus aureus subsp. aureus MW2; identical to SEQ ID NO: 4250710

SEQ ID NO: 4251547 - RNA, 81 nt, Staphylococcus aureus subsp. aureus MW2
gcgauuacuaaaugcuacaaacgcuugugcauuauuaucaagauuuaaugaugccaagaauuuuaguaaguaaagacccgc

SEQ ID NO: 4251548 - RNA, 73 nt, Staphylococcus aureus subsp. aureus MW2; identical to SEQ ID NO: 4251393

SEQ ID NO: 4251549 - RNA, 96 nt, Staphylococcus aureus subsp. aureus MW2; identical to SEQ ID NO: 4251090

SEQ ID NO: 4251550 - RNA, 55 nt, Staphylococcus aureus subsp. aureus MW2
aaaaaccccuaaucaugaaguugguuuagacaaccagcggugacuagggguuuuu

SEQ ID NO: 4251551 - RNA, 55 nt, Staphylococcus aureus subsp. aureus MW2; identical to SEQ ID NO: 4251012

SEQ ID NO: 4251552 - RNA, 56 nt, Staphylococcus aureus subsp. aureus MW2; identical to SEQ ID NO: 4250707

SEQ ID NO: 4251553 - RNA, 61 nt, Staphylococcus aureus subsp. aureus MW2
gauaugaauaugaugugucugaugauauaagugucauguacagacaccucauauugguauu

SEQ ID NO: 4251554 - RNA, 69 nt, Staphylococcus aureus subsp. aureus MW2
aguuagugaaaugagagucugaaacauaucaaucuuuugauauuguauuaggcucuuauuuuuauagcu

SEQ ID NO: 4251555 - RNA, 56 nt, Staphylococcus aureus subsp. aureus MW2
aaaagcuucuaaugugauaucggaaccucggauuccauaucauguuagaagcuuuu

SEQ ID NO: 4251556 - RNA, 64 nt, Staphylococcus aureus subsp. aureus MW2; identical to SEQ ID NO: 4251001

SEQ ID NO: 4251557 - RNA, 82 nt, Staphylococcus aureus subsp. aureus MW2
ugcuauaguaguucuguaaacgauugcaugguaugcaaauauuaauguaccaaaaucgauaauuuauaguauaauuacggca

SEQ ID NO: 4251558 - RNA, 99 nt, Staphylococcus aureus subsp. aureus MW2
aagcuagaaacaaugcgaagaaaucaucgaacaugaaugauauugauuugauucauuacauguuacugaugaacauaccugcauauguguuucuagcuu

SEQ ID NO: 4251559 - RNA, 81 nt, Staphylococcus aureus subsp. aureus MW2
uaaauucgacuggauuauuuugagauaauaggccuucuaucguuuuagguuuauuuucuucuuuugguuuaaauugauuua

SEQ ID NO: 4251560 - RNA, 56 nt, Staphylococcus aureus subsp. aureus MW2; identical to SEQ ID NO: 4251023

SEQ ID NO: 4251561 - RNA, 57 nt, Staphylococcus aureus subsp. aureus MW2; identical to SEQ ID NO: 4251307

SEQ ID NO: 4251562 - RNA, 96 nt, Staphylococcus aureus subsp. aureus MW2
gccauuaagugauagcucaauaccguuaguagcuaacuuaucuuuaauguauguuagugaugguauagauucaacauguucaucaucuguaauggu

SEQ ID NO: 4251563 - RNA, 69 nt, Staphylococcus aureus subsp. aureus MW2
uagaugaacuuaauuugaugacagaacgugauauucaauuauaugacgauaucaauuuaaguuugccug

SEQ ID NO: 4251564 - RNA, 77 nt, Staphylococcus aureus subsp. aureus MW2; identical to SEQ ID NO: 4250720

SEQ ID NO: 4251565 - RNA, 69 nt, Staphylococcus aureus subsp. aureus MW2; identical to SEQ ID NO: 4250952

SEQ ID NO: 4251566 - RNA, 71 nt, Staphylococcus aureus subsp. aureus MW2
acauaaauaaaacauuguacaggcugggacauaaaucaauguucuaugcucuacgaaguuauauuggcagu

SEQ ID NO: 4251567 - RNA, 56 nt, Staphylococcus aureus subsp. aureus MW2; identical to SEQ ID NO: 4251147

SEQ ID NO: 4251568 - RNA, 126 nt, Staphylococcus aureus subsp. aureus MW2
uguaauugaaaaugcugcuaaagaaccggaaguaguugauguugcuaacuucuuaacaaguaugggagcuaauauuaagggagcggguacaucaacaauuaaaaucaauggcgucaaagaauuaca

SEQ ID NO: 4251569 - RNA, 61 nt, Staphylococcus aureus subsp. aureus MW2; identical to SEQ ID NO: 4251102

SEQ ID NO: 4251570 - RNA, 71 nt, Staphylococcus aureus subsp. aureus MW2; identical to SEQ ID NO: 4250751

SEQ ID NO: 4251571 - RNA, 73 nt, Staphylococcus aureus subsp. aureus MW2
uaauaaugauauggcaagcuauauagauaugcuuuuucaggcauuguuugauggaaugcuguaucaaaaauug

SEQ ID NO: 4251572 - RNA, 65 nt, Staphylococcus aureus subsp. aureus MW2
guauuaaaugucauuuauuugaauguguuaauuaugaaagaaaaagaguaagugacguuaaauau

SEQ ID NO: 4251573 - RNA, 60 nt, Staphylococcus aureus subsp. aureus MW2
gguucgucauuuuaaucaaauucaaacgaaagugcgggagcaugauuuuagaugggaacc

SEQ ID NO: 4251574 - RNA, 79 nt, Staphylococcus aureus subsp. aureus MW2; identical to SEQ ID NO: 4250810

SEQ ID NO: 4251575 - RNA, 93 nt, Staphylococcus aureus subsp. aureus MW2; identical to SEQ ID NO: 4250808

SEQ ID NO: 4251576 - RNA, 59 nt, Staphylococcus aureus subsp. aureus MW2
uauuauugacucuacaggcugauuucaaagcauuauugauagccugaagguuaauuaua

SEQ ID NO: 4251577 - RNA, 61 nt, Staphylococcus aureus subsp. aureus MW2
gccugaaaaugauaaagcgguagggaacguaguguguuccacugcugauuucuuuuugagc

SEQ ID NO: 4251578 - RNA, 55 nt, Staphylococcus aureus subsp. aureus MW2; identical to SEQ ID NO: 4251327

SEQ ID NO: 4251579 - RNA, 69 nt, Staphylococcus aureus subsp. aureus MW2
auguuaaaaacacgcggugggcgaaaucaguuugaauugacugacuucguuuuaccgcguguuuaauau

SEQ ID NO: 4251580 - RNA, 82 nt, Staphylococcus aureus subsp. aureus MW2
cuagugucuggcauuacaguuacagcaaucgcuuuaguugguucaacagcaguugcagguguaauuggugccggugguuuag

SEQ ID NO: 4251581 - RNA, 65 nt, Staphylococcus aureus subsp. aureus MW2; identical to SEQ ID NO: 4251260

SEQ ID NO: 4251582 - RNA, 63 nt, Staphylococcus aureus subsp. aureus MW2
aucauggagugggauagaagugauaugaucacaaacuuuauuucguuaucccacucacaugau

SEQ ID NO: 4251583 - RNA, 73 nt, Staphylococcus aureus subsp. aureus MW2; identical to SEQ ID NO: 4250665

SEQ ID NO: 4251584 - RNA, 103 nt, Staphylococcus aureus subsp. aureus MW2; identical to SEQ ID NO: 4250660

SEQ ID NO: 4251585 - RNA, 65 nt, Staphylococcus aureus subsp. aureus MW2
ggcaagguugacuagaauugaaaaaagcuuguuacaagcguauuuucauucagucaacuacugcc

SEQ ID NO: 4251586 - RNA, 78 nt, Staphylococcus aureus subsp. aureus MW2; identical to SEQ ID NO: 4251242

SEQ ID NO: 4251587 - RNA, 86 nt, Staphylococcus aureus subsp. aureus MW2
gcgaaagauuuauucuuuucagguaaaucauugauagauguauauagucaauuugcuggauuagcugaaaugauaaauguuuuugc

SEQ ID NO: 4251588 - RNA, 117 nt, Staphylococcus aureus subsp. aureus MW2
gguacaucuagugauuuacgugacuuaucagaagaagcugaaucagguaaagcacguucacaaauggcuuuagauguauuugcuucuaaaauucacaaauauauuggaucauaugcu

SEQ ID NO: 4251589 - RNA, 112 nt, Staphylococcus aureus subsp. aureus MW2
ucguuaacaccuugagacucaauguauugacugugauuuggaguguauaaugcuacuguuuugucuauagccaucgcaucaaauauuauauuugaguaaucagugauaacga

SEQ ID NO: 4251590 - RNA, 55 nt, Staphylococcus aureus subsp. aureus MW2; identical to SEQ ID NO: 4251319

SEQ ID NO: 4251591 - RNA, 73 nt, Staphylococcus aureus subsp. aureus MW2
gaucuaacuuauuuaaugauggugcuuccuuuauucgacuuugugaagguagauuguuauuagcguuugaauc

SEQ ID NO: 4251592 - RNA, 62 nt, Staphylococcus aureus subsp. aureus MW2
gcguuguauauggugcgauuucuggauucuucgguggacgugucgauacgauuaugcaacgu

SEQ ID NO: 4251593 - RNA, 70 nt, Staphylococcus aureus subsp. aureus MW2
ugcugcaggucaacguuuaaaagaauuuguaacagacacaucaaaaaucuuagacgaugcauuuguagca

SEQ ID NO: 4251594 - RNA, 56 nt, Staphylococcus aureus subsp. aureus MW2
acaccaacaaaacagagguuuucgcuaaugauugcgaagaccucuguuuuuggugu

SEQ ID NO: 4251595 - RNA, 130 nt, Staphylococcus aureus subsp. aureus MW2
ugccaauguuguugauauuguauaugacacgauuuggggcgauagugaggauacagugcaagcagaacaugugggggaagacacugcguccucaaaagugcaugagcaacacacuacuaaugucaaagua

SEQ ID NO: 4251596 - RNA, 82 nt, Staphylococcus aureus subsp. aureus MW2
auagauauguauugccugcaauaauugcagccggguugucagacagcuuacuuauuauuauugcagugguaggaguaucuau

SEQ ID NO: 4251597 - RNA, 95 nt, Staphylococcus aureus subsp. aureus MW2
gcauucgaagguacauuauuagcgcauacugauggugguguuccuaacaugguagugaacauuccacaauuagaugaagaaacuuucgguuaugu

SEQ ID NO: 4251598 - RNA, 94 nt, Staphylococcus aureus subsp. aureus MW2
guuuucacuuagcguuaauuuaucacucaugucauugguaacaucuuuaaauuucucuugaucauuuguguuagcauagacgcuuucugguaau

SEQ ID NO: 4251599 - RNA, 59 nt, Staphylococcus aureus subsp. aureus MW2; identical to SEQ ID NO: 4250911

SEQ ID NO: 4251600 - RNA, 78 nt, Staphylococcus aureus subsp. aureus MW2
gaaguaguuaaugguaucgcagaaaagccuaaucguccuaagcuaggugucauuccuauggguacuguuaaugacuuu

SEQ ID NO: 4251601 - RNA, 59 nt, Staphylococcus aureus subsp. aureus MW2; identical to SEQ ID NO: 4251058

SEQ ID NO: 4251602 - RNA, 69 nt, Staphylococcus aureus subsp. aureus MW2
guuauggcaaaaucaugcuugcauauacuuacuaauaaugaauaugcgacaacgcguugccaagauggc

SEQ ID NO: 4251603 - RNA, 115 nt, Staphylococcus aureus subsp. aureus MW2; identical to SEQ ID NO: 4250839

SEQ ID NO: 4251604 - RNA, 57 nt, Staphylococcus aureus subsp. aureus MW2
uuuuaccuaacuaccauucauacaaaauauaaauauguaugauagggaagggugaga

SEQ ID NO: 4251605 - RNA, 64 nt, Staphylococcus aureus subsp. aureus MW2
aaacguuuagcauaucuugauucaacagcgacaagucaaacgccugugcaaguguuaaauguuu

SEQ ID NO: 4251606 - RNA, 129 nt, Staphylococcus aureus subsp. aureus MW2; identical to SEQ ID NO: 4250768

SEQ ID NO: 4251607 - RNA, 70 nt, Staphylococcus aureus subsp. aureus MW2; identical to SEQ ID NO: 4250695

SEQ ID NO: 4251608 - RNA, 82 nt, Staphylococcus aureus subsp. aureus MW2
uguuugaugaugaggaguauuuguuccauguguugcguaauggugcgaaagguuacauauugaaaaaugcaccugaugaaca

SEQ ID NO: 4251609 - RNA, 88 nt, Staphylococcus aureus subsp. aureus MW2
uucagaaaugauggagugggaagauggaaaagaauacccaguuauucguuuagauauuucaucugauucacauccauucuacacugga

SEQ ID NO: 4251610 - RNA, 58 nt, Staphylococcus aureus subsp. aureus MW2; identical to SEQ ID NO: 4250901

SEQ ID NO: 4251611 - RNA, 83 nt, Staphylococcus aureus subsp. aureus MW2
ugcguaccaaagaugucggaguuaucaucaaccauuuguaccaaauccaaacguugugcaauaucuuuagacacuggugcgca

SEQ ID NO: 4251612 - RNA, 69 nt, Staphylococcus aureus subsp. aureus MW2; identical to SEQ ID NO: 4250764

SEQ ID NO: 4251613 - RNA, 57 nt, Staphylococcus aureus subsp. aureus MW2
uuggggugggacgacgaaauaaauuuugcgaaaauaucauuucugucccacucccaa

SEQ ID NO: 4251614 - RNA, 118 nt, Staphylococcus aureus subsp. aureus MW2
acauccauuaaauuaaucaugacaucaauaaaaagcgaccaguucgcaguuuacaauucguaacacugcaaaauuggucgcuuuauuuuguauguuauucgauuauaaaauaugaugu

SEQ ID NO: 4251615 - RNA, 75 nt, Staphylococcus aureus subsp. aureus MW2; identical to SEQ ID NO: 4251083

SEQ ID NO: 4251616 - RNA, 113 nt, Staphylococcus aureus subsp. aureus MW2; identical to SEQ ID NO: 4251193

SEQ ID NO: 4251617 - RNA, 59 nt, Staphylococcus aureus subsp. aureus MW2; identical to SEQ ID NO: 4250881

SEQ ID NO: 4251618 - RNA, 73 nt, Staphylococcus aureus subsp. aureus MW2
caacgucaaucuauauuagagauacucgcucaaguggaagugaauauugauuauccugaauacgaugauguug

SEQ ID NO: 4251619 - RNA, 61 nt, Staphylococcus aureus subsp. aureus MW2
uuacaaacuuuaucagaugaugaaaaguuagaguuguuaucaucugaugguauguuaguaa

SEQ ID NO: 4251620 - RNA, 82 nt, Staphylococcus aureus subsp. aureus MW2; identical to SEQ ID NO: 4250912

SEQ ID NO: 4251621 - RNA, 62 nt, Staphylococcus aureus subsp. aureus MW2; identical to SEQ ID NO: 4251188

SEQ ID NO: 4251622 - RNA, 78 nt, Staphylococcus aureus subsp. aureus MW2
agccuuuaaaauaaaagaacugcuagcugaaauguuaugagauauucauaacuacggcuagcaguuuuuuuaugcgcu

SEQ ID NO: 4251623 - RNA, 63 nt, Staphylococcus aureus subsp. aureus MW2
uugaacauucagacauugaugacguaucuucaaucgacacgucuacauuaaugcuaaugucag

SEQ ID NO: 4251624 - RNA, 77 nt, Staphylococcus aureus subsp. aureus MW2; identical to SEQ ID NO: 4251038

SEQ ID NO: 4251625 - RNA, 61 nt, Staphylococcus aureus subsp. aureus MW2
gccauacauaugaaguggauagcugcauaacgcacugcauuaucaacuugaauguaugagu

SEQ ID NO: 4251626 - RNA, 57 nt, Staphylococcus aureus subsp. aureus MW2
aacugguacuuuaucgcagcgagugucguuguauuacuuccuacgauauugcuaguu

SEQ ID NO: 4251627 - RNA, 66 nt, Staphylococcus aureus subsp. aureus MW2
auaaccuaauagaugugaagucgcuuuuccuagaggauaguuacgacuuucuguuucauuaguugu

SEQ ID NO: 4251628 - RNA, 82 nt, Staphylococcus aureus subsp. aureus MW2
uugaaucuuuuguaaaagauguuuuuuuauaauuauuggugaaaacguguaguuauggugaaacucaaagauaauaauuuaa

SEQ ID NO: 4251629 - RNA, 64 nt, Staphylococcus aureus subsp. aureus MW2
aaaaaggaacaaagcagcuauuuaugauuugugucauaucgauagcaucguuuuguuccuuuuu

SEQ ID NO: 4251630 - RNA, 130 nt, Staphylococcus aureus subsp. aureus MW2
agauguuguagacuuauacauucaauacccagauauuguagauaaauuagcguuguuaaaaggucaagaauuugaaauugcaacaauuaaugaucuuacagaagcuuuugaagcagaccugucuacgucu

SEQ ID NO: 4251631 - RNA, 81 nt, Staphylococcus aureus subsp. aureus MW2
gguugaugguacuuauuauuaugcuguacauuuugauagucauguugaucaagaagucauuaaugauaguuacagucaauu

SEQ ID NO: 4251632 - RNA, 68 nt, Staphylococcus aureus subsp. aureus MW2
gauggaucuuugcguugcuguaauaauuugcgaaccguauuaucuauugcagcaaugugaucugcauc

SEQ ID NO: 4251633 - RNA, 83 nt, Staphylococcus aureus subsp. aureus MW2; identical to SEQ ID NO: 4250694

SEQ ID NO: 4251634 - RNA, 77 nt, Staphylococcus aureus subsp. aureus MW2
gcugaggguguaacuacaauuuacaauguaaaacauauuuauagagguuauacagauauuguagaacacuuaaaagc

SEQ ID NO: 4251635 - RNA, 60 nt, Staphylococcus aureus subsp. aureus MW2; identical to SEQ ID NO: 4250766

SEQ ID NO: 4251636 - RNA, 67 nt, Staphylococcus aureus subsp. aureus MW2; identical to SEQ ID NO: 4251301

SEQ ID NO: 4251637 - RNA, 100 nt, Staphylococcus aureus subsp. aureus MW2
gguaugucaacauuuuuuuagacauuuuucauauguagauuuuuaaaugccacuggcgucaaauacuguaaugaagaauguagucuaaaauuguuauacc

SEQ ID NO: 4251638 - RNA, 61 nt, Staphylococcus aureus subsp. aureus MW2; identical to SEQ ID NO: 4251385

SEQ ID NO: 4251639 - RNA, 58 nt, Staphylococcus aureus subsp. aureus MW2; identical to SEQ ID NO: 4251158

SEQ ID NO: 4251640 - RNA, 78 nt, Staphylococcus aureus subsp. aureus MW2
agauuaauaguuuuauaagaagguguuugaucuugagcuaaccacaucauucgaauacuguuaugaaguaauuuuucu

SEQ ID NO: 4251641 - RNA, 96 nt, Staphylococcus aureus subsp. aureus MW2; identical to SEQ ID NO: 4251361

SEQ ID NO: 4251642 - RNA, 88 nt, Staphylococcus aureus subsp. aureus MW2; identical to SEQ ID NO: 4250761

SEQ ID NO: 4251643 - RNA, 112 nt, Staphylococcus aureus subsp. aureus MW2
agcuguagcacuaaacuauggucauguuuuaccguuaguagcuaaauaucuuauaaaucgugaagaugaaguuauucaaugguuuuacaaggaaguagauugguuugaagcu

SEQ ID NO: 4251644 - RNA, 61 nt, Staphylococcus aureus subsp. aureus MW2; identical to SEQ ID NO: 4251108

SEQ ID NO: 4251645 - RNA, 70 nt, Staphylococcus aureus subsp. aureus MW2
uuugcguaccauuguuaguaauaagaauaacacugucguucgaauugugaguugcuaauaauguugcaaa

SEQ ID NO: 4251646 - RNA, 57 nt, Staphylococcus aureus subsp. aureus MW2; identical to SEQ ID NO: 4251300

SEQ ID NO: 4251647 - RNA, 86 nt, Staphylococcus aureus subsp. aureus MW2
gaaguguuauaaauagagaacagcaguaagacgauuucaaugagaagcugucuuacugcuguuuuuagguuauauuuaaaugcuuu

SEQ ID NO: 4251648 - RNA, 75 nt, Staphylococcus aureus subsp. aureus MW2
aguguuaaguuugauuaauguguuuagagcuggaucaauggcuuuacuucaaaucauuuucggacuuuuagcauu

SEQ ID NO: 4251649 - RNA, 130 nt, Staphylococcus aureus subsp. aureus MW2
gauuaagccaaccauucaagauacugaacauuaauaaaacccuuagcuagauugaaaaugggaaucaugcaauucaagcauggaccuguaaucuaguuagggguuuuuaucuuuaaugaaugacuucauu

SEQ ID NO: 4251650 - RNA, 74 nt, Staphylococcus aureus subsp. aureus MW2
ggcaaugcgaguuggggugggacgacgaaauaaauuuuacgaaaauaucauuucugucccacucccauggugcc

SEQ ID NO: 4251651 - RNA, 104 nt, Staphylococcus aureus subsp. aureus MW2
auaaaaauaauuaacucuauuugaacaaugcguuagucgaugccuuuaauauuuagaagugcauugucuaacguauuuuuuuaaaguucgucaaugguuuuugu

SEQ ID NO: 4251652 - RNA, 129 nt, Staphylococcus aureus subsp. aureus MW2
ggucucaagcaauaguauuguucauuugaaauaucaucuugagauauaggcaugguuuaagagagguuuuuaaagaugucuaaauuuaaaguuaagcguuuaacugcacacauacuaauguugaaaguc

SEQ ID NO: 4251653 - RNA, 78 nt, Staphylococcus aureus subsp. aureus MW2
uuuaaauuuuggguuguuuauuucucuagcuauuuggucaauaaauucgauggguaauaaacaaugcauuaguuugaa

SEQ ID NO: 4251654 - RNA, 67 nt, Staphylococcus aureus subsp. aureus MW2
uggcaguaguugacugaaugaaaauacgcuuguaacaagcuuuuuucaauucuagucaaccuugccg

SEQ ID NO: 4251655 - RNA, 88 nt, Staphylococcus aureus subsp. aureus MW2
cggcgaaagcgcaaacagguaaauacuacaucacuggugacuuagcucauguagaugaugaugguuauuucugguuugaaggacgucg

SEQ ID NO: 4251656 - RNA, 100 nt, Staphylococcus aureus subsp. aureus MW2; identical to SEQ ID NO: 4251287

SEQ ID NO: 4251657 - RNA, 71 nt, Staphylococcus aureus subsp. aureus MW2
ucaauuguaaugguagcugucuugauauggauugcaauuaaaacauauaaagauucaguacuuacauuuga

SEQ ID NO: 4251658 - RNA, 68 nt, Staphylococcus aureus subsp. aureus MW2
aggagaguaaugguauuaaagcugaacuuccaaaucuugaagaagagcuuaaaauauuauugauuccu

SEQ ID NO: 4251659 - RNA, 67 nt, Staphylococcus aureus subsp. aureus MW2
ugccaaugggagugggacagaaaugauauuuucgcaaaauuauuucgucgucccaccccaacuugca

SEQ ID NO: 4251660 - RNA, 79 nt, Staphylococcus aureus subsp. aureus MW2
uaugaaaucgaugaauggaaagauugguugaagcacgucuucgaacaagacauugccaauuuaucuauucaucuucgua

SEQ ID NO: 4251661 - RNA, 130 nt, Staphylococcus aureus subsp. aureus MW2
cguguauuaaaguaaguuuuuauuagugcauaaugccgggaaugauguaaaacuguauauaguuuugacuaauuagaaaauuacauuaugaacgaguaugauguauucuaaguacaaauuagaaugcacg

SEQ ID NO: 4251662 - RNA, 82 nt, Staphylococcus aureus subsp. aureus MW2
aggcguuaagcuaucaugcauguuauuaacagaacccguuguaaaugccgucguaauaacuguaaauagugcugacaagccu

SEQ ID NO: 4251663 - RNA, 130 nt, Staphylococcus aureus subsp. aureus MW2
aaguucguaaaaaauccaauggauauugucaguguuggugauaucguugacguuuggauuuacaguauugacaaaaauaaagacaaaguaucauuaacgaugauugauccacaugaauaaugacaaacuu

SEQ ID NO: 4251664 - RNA, 65 nt, Staphylococcus aureus subsp. aureus MW2; identical to SEQ ID NO: 4250809

SEQ ID NO: 4251665 - RNA, 113 nt, Staphylococcus aureus subsp. aureus MW2
auuguugauguauuuuuggcagccauaauaccagcgauuugagcaguguucaauacauugccuuugguauugguguuauuagaaaucugcuuaaaaauaguuuuauuuacagu

SEQ ID NO: 4251666 - RNA, 68 nt, Staphylococcus aureus subsp. aureus MW2
auacuuuaaauaauauuuuaaaaaguggugacgaagcugucgccacuuuuuuugugcuguaaaaguau

SEQ ID NO: 4251667 - RNA, 87 nt, Staphylococcus aureus subsp. aureus MW2
uuuuugagugaggauacagauucaucguacauauuagacaaaagcaauggugcuuucuaagugaugauguuuguguaaauugagaaa

SEQ ID NO: 4251668 - RNA, 75 nt, Staphylococcus aureus subsp. aureus MW2
gcgcauaaaauugguggcgaauaugguauuccgcaugguagagcgaaugcgauauuacuaccgcauauuauccgu

SEQ ID NO: 4251669 - RNA, 125 nt, Staphylococcus aureus subsp. aureus MW2
ggcaaaugaaaaugguuucgcgugagcuuucggcuaauuuaucacaauuuucuagauaugauaauucauuagaaaagucgaagauaaaagucgaagguuugaguaaaaaacaaaaaguucaagcc

SEQ ID NO: 4251670 - RNA, 72 nt, Staphylococcus aureus subsp. aureus MW2
aagguguggaacagacauguguuauacgggaaauugggcgaaccgcaacuauuauacauugauuuacaccuu

SEQ ID NO: 4251671 - RNA, 102 nt, Staphylococcus aureus subsp. aureus MW2
gguauuuaguauaacauuguucauaggcgcaauugucuccuuuaguuuagguuuggucacuuuaaauuacagaggcaauugcgcuuuuuuauauucaaaauc

SEQ ID NO: 4251672 - RNA, 83 nt, Staphylococcus aureus subsp. aureus MW2; identical to SEQ ID NO: 4251195

SEQ ID NO: 4251673 - RNA, 129 nt, Staphylococcus aureus subsp. aureus MW2; identical to SEQ ID NO: 4251345

SEQ ID NO: 4251674 - RNA, 55 nt, Staphylococcus aureus subsp. aureus MW2
gcaggcaugaacaaacaagacuauucucauagugcgguuguuugcucaugccugc

SEQ ID NO: 4251675 - RNA, 66 nt, Staphylococcus aureus subsp. aureus MW2; identical to SEQ ID NO: 4250734

SEQ ID NO: 4251676 - RNA, 98 nt, Staphylococcus aureus subsp. aureus MW2
ucacuugcguguuacugguaaugcaggcaugagcaaacaaccgcacuaugagaauagucuuguuuguucaugccugcuuuuuuuguacauggaagcgg

SEQ ID NO: 4251677 - RNA, 58 nt, Staphylococcus aureus subsp. aureus MW2; identical to SEQ ID NO: 4251070

SEQ ID NO: 4251678 - RNA, 91 nt, Staphylococcus aureus subsp. aureus MW2
uauaacauuaaaaagcaugauacucaauaaaauuggaacacgaaauugugaacuaaauugaaugagugucaugcuuaauuuauguguugug

SEQ ID NO: 4251679 - RNA, 83 nt, Staphylococcus aureus subsp. aureus MW2
agcuggcuuacgccguguuuuagcugaaacaagucaauauauuacuaaugaauuugauuuuacugaagcggaacaagcugguu

SEQ ID NO: 4251680 - RNA, 70 nt, Staphylococcus aureus subsp. aureus MW2
uucuuuaggaugauucgcgugauguauggcuugcuuuaacauaguugcuacguggaugucaucuaaugaa

SEQ ID NO: 4251681 - RNA, 91 nt, Staphylococcus aureus subsp. aureus MW2
gcuacgcugcuauuaauugcgauugguauaguaguuuaucuuuuauuaaugaugacuaugaaaaaucaauacguauggcaaauauugaggc

SEQ ID NO: 4251682 - RNA, 70 nt, Staphylococcus aureus subsp. aureus MW2
gaugaugauuuugguuauggcucuacggauacagggaacguaagucauguugugccaacaauacauccuc

SEQ ID NO: 4251683 - RNA, 59 nt, Staphylococcus aureus subsp. aureus MW2; identical to SEQ ID NO: 4250740

SEQ ID NO: 4251684 - RNA, 88 nt, Staphylococcus aureus subsp. aureus MW2; identical to SEQ ID NO: 4250673

SEQ ID NO: 4251685 - RNA, 78 nt, Staphylococcus aureus subsp. aureus MW2
uagcgauugauacauuuccugagcaacaguuacuaucuuuaaaaguauuuguugauacgaaagaugcuaugggcgcua

SEQ ID NO: 4251686 - RNA, 70 nt, Staphylococcus aureus subsp. aureus MW2
agcgggacggaaaugauaaagaacgacuaaugauugauuauguagcgauucuuuaucauuagucacagcu

SEQ ID NO: 4251687 - RNA, 70 nt, Staphylococcus aureus subsp. aureus MW2
aguagacgaauugaugcauugauaugauuguuauaaugcucaauacauaucguuauaucauucgucuacu

SEQ ID NO: 4251688 - RNA, 57 nt, Staphylococcus aureus subsp. aureus MW2; identical to SEQ ID NO: 4250934

SEQ ID NO: 4251689 - RNA, 115 nt, Staphylococcus aureus subsp. aureus MW2
guguuuaacaacauuauuagcgauuaguuccccuauuauuuaugacaauaugcagucaaucaaugaaacauguauguaugaguauauuuggaacuaguaauguauuguuaaauau

SEQ ID NO: 4251690 - RNA, 56 nt, Staphylococcus aureus subsp. aureus MW2
uaacuguucaagauauugccaagcaccugcaacaaaaggcuuauuuagaacgguug

SEQ ID NO: 4251691 - RNA, 58 nt, Staphylococcus aureus subsp. aureus MW2
uguaucauuuaagcugaaacgcggacaaauaguuggucucguuggagcgaauggugca

SEQ ID NO: 4251692 - RNA, 62 nt, Staphylococcus aureus subsp. aureus MW2
uagacaccaaaaacagaggucuucgcaaucauuagcgaaaaccucuguuuuguugguguuua

SEQ ID NO: 4251693 - RNA, 76 nt, Staphylococcus aureus subsp. aureus MW2; identical to SEQ ID NO: 4250885

SEQ ID NO: 4251694 - RNA, 115 nt, Staphylococcus aureus subsp. aureus MW2
uauugaagauguugugauguaacuugaacgauuaaaagcuaucuguuauauagcucuaccccuuuguuuaaucgcucccccuguuacaaguaauaucauagcacaaucuuuuuua

SEQ ID NO: 4251695 - RNA, 129 nt, Staphylococcus aureus subsp. aureus MW2; identical to SEQ ID NO: 4250875

SEQ ID NO: 4251696 - RNA, 117 nt, Staphylococcus aureus subsp. aureus MW2
aaugauuauuuuucagaagagacgguugaaaugauguuaucaaacauugaagucauuguuggugauuucgaguguauggaugauguuguuuuaccagaaaacauggauacgauuauu

SEQ ID NO: 4251697 - RNA, 61 nt, Staphylococcus aureus subsp. aureus MW2
agaaugugcuaaaggagcucgaaacaauaaauuguuccagcuccuuuaagcaccgaugucu

SEQ ID NO: 4251698 - RNA, 80 nt, Staphylococcus aureus subsp. aureus MW2; identical to SEQ ID NO: 4251047

SEQ ID NO: 4251699 - RNA, 63 nt, Staphylococcus aureus subsp. aureus MW2
gucuaugcuaaggacauuauucugcauuuaauuaaaacguaugguguugacuuugguacaggc

SEQ ID NO: 4251700 - RNA, 97 nt, Staphylococcus aureus subsp. aureus MW2
auuaagauugaaauguaauaaauaaagaacagcaguaagguacuuucaaauugaaaugaucuuggugcuguuuuucuugauugauuuucgucauaau

SEQ ID NO: 4251701 - RNA, 61 nt, Staphylococcus aureus subsp. aureus MW2
ggcuguaauuauuguagcuauaaccauuguuguaauuguuguaguuauaguuauuguagcc

SEQ ID NO: 4251702 - RNA, 73 nt, Staphylococcus aureus subsp. aureus MW2
gccagauauuugcaagaucauugaacacaucgaacuacuagagaugauagcaauaucugcuaauguuaacggc

SEQ ID NO: 4251703 - RNA, 77 nt, Staphylococcus aureus subsp. aureus MW2; identical to SEQ ID NO: 4250913

SEQ ID NO: 4251704 - RNA, 85 nt, Staphylococcus aureus subsp. aureus MW2; identical to SEQ ID NO: 4250915

SEQ ID NO: 4251705 - RNA, 87 nt, Staphylococcus aureus subsp. aureus MW2
auuggucuucaauuaauggcaguuauagcauuauucaguauuuuauuaaauauuaaauacaugauugucguuauuaugaugauuggu

SEQ ID NO: 4251706 - RNA, 80 nt, Staphylococcus aureus subsp. aureus MW2; identical to SEQ ID NO: 4250803

SEQ ID NO: 4251707 - RNA, 63 nt, Staphylococcus aureus subsp. aureus MW2
cgcaauauuaucaagcucuuucguagugauaccugguuugguugcagcuugcauuguauugcg

SEQ ID NO: 4251708 - RNA, 110 nt, Staphylococcus aureus subsp. aureus MW2
gccaguguauguucaguagcugaaaucguauuaccaucuggggcauuaauaacuaaaauaccuuuuaauguugcagcauuaauauuaauauuaucuacaccaacaccggc

SEQ ID NO: 4251709 - RNA, 57 nt, Staphylococcus aureus subsp. aureus MW2; identical to SEQ ID NO: 4251165

SEQ ID NO: 4251710 - RNA, 65 nt, Staphylococcus aureus subsp. aureus MW2
aauaaagacuuggucgaaucguggaugauauauuaucaaacgcacggcucgaacaagucuuuuuu

SEQ ID NO: 4251711 - RNA, 75 nt, Staphylococcus aureus subsp. aureus MW2
uugaagcaucagcaacugcuguauugucaggaauaaauuguaaaucuaaacgaucagcaucuguugguacuuuaa

SEQ ID NO: 4251712 - RNA, 61 nt, Staphylococcus aureus subsp. aureus MW2
auaaagugcucucuuagaaguagauuuucagucaauaacugcuuuuaagagagcauuuugu

SEQ ID NO: 4251713 - RNA, 60 nt, Staphylococcus aureus subsp. aureus MW2; identical to SEQ ID NO: 4251325

SEQ ID NO: 4251714 - RNA, 82 nt, Staphylococcus aureus subsp. aureus MW2
gucuucgucuguguuguaaauguuuuaucuuucgcuuuaccugaagcugaaaugguaauaucuuuauuuuguggauauggac

SEQ ID NO: 4251715 - RNA, 67 nt, Staphylococcus aureus subsp. aureus MW2; identical to SEQ ID NO: 4251176

SEQ ID NO: 4251716 - RNA, 84 nt, Staphylococcus aureus subsp. aureus MW2
acauggauuuaugccuuauauucagauguaaacggcgauuauauuaaaaagccaaucacagaauguagugguaaugaaauaugu

SEQ ID NO: 4251717 - RNA, 87 nt, Staphylococcus aureus subsp. aureus MW2; identical to SEQ ID NO: 4251004

SEQ ID NO: 4251718 - RNA, 62 nt, Staphylococcus aureus subsp. aureus MW2
gauuacuaugacuauuguauuugcuauauugcuauuaguuuguaucaguauuaauagugauc

SEQ ID NO: 4251719 - RNA, 90 nt, Staphylococcus aureus subsp. aureus MW2; identical to SEQ ID NO: 4250899

SEQ ID NO: 4251720 - RNA, 60 nt, Staphylococcus aureus subsp. aureus MW2; identical to SEQ ID NO: 4251383

SEQ ID NO: 4251721 - RNA, 67 nt, Staphylococcus aureus subsp. aureus MW2; identical to SEQ ID NO: 4250733

SEQ ID NO: 4251722 - RNA, 65 nt, Staphylococcus aureus subsp. aureus MW2; identical to SEQ ID NO: 4251053

SEQ ID NO: 4251723 - RNA, 65 nt, Staphylococcus aureus subsp. aureus MW2; identical to SEQ ID NO: 4251054

SEQ ID NO: 4251724 - RNA, 66 nt, Staphylococcus aureus subsp. aureus MW2; identical to SEQ ID NO: 4251294

SEQ ID NO: 4251725 - RNA, 64 nt, Staphylococcus aureus subsp. aureus MW2; identical to SEQ ID NO: 4250798

SEQ ID NO: 4251726 - RNA, 68 nt, Staphylococcus aureus subsp. aureus MW2
auuuaagguaugauuuggcucauguagauauaaaucuucaaaaugcgagccaugauuauccuuuaaau

SEQ ID NO: 4251727 - RNA, 68 nt, Staphylococcus aureus subsp. aureus MW2; identical to SEQ ID NO: 4250977

SEQ ID NO: 4251728 - RNA, 55 nt, Staphylococcus aureus subsp. aureus MW2; identical to SEQ ID NO: 4251030

SEQ ID NO: 4251729 - RNA, 60 nt, Staphylococcus aureus subsp. aureus MW2; identical to SEQ ID NO: 4251314

SEQ ID NO: 4251730 - RNA, 107 nt, Staphylococcus aureus subsp. aureus MW2
aauaugaugauuguuuucagugauuuccucgauuggaccuugagcuugaccauguucuucugguaguucauccacuaguucaaucagauuacuuucagucguauauu

SEQ ID NO: 4251731 - RNA, 92 nt, Staphylococcus aureus subsp. aureus MW2
gaaacgaauuugcauaaaagacuagcucuuuuaguguuaucaauuguuggugauaaaacuagaaauauaguuauuggagcaauuaucguuuc

SEQ ID NO: 4251732 - RNA, 76 nt, Staphylococcus aureus subsp. aureus MW2; identical to SEQ ID NO: 4250844

SEQ ID NO: 4251733 - RNA, 79 nt, Staphylococcus aureus subsp. aureus MW2
auagaauauaauguacugucuuuuaguaauggaugcguuucuuauauauguauguuucuaaaaaacaguacguuuuuau

SEQ ID NO: 4251734 - RNA, 55 nt, Staphylococcus aureus subsp. aureus MW2; identical to SEQ ID NO: 4250684

SEQ ID NO: 4251735 - RNA, 110 nt, Staphylococcus aureus subsp. aureus MW2
uguuuuaguguucgguguugaaaagucaucauuuuuaguuccgaguuuaauagaaggacauaaagcgacuaaagauaaugaaguguuagcugaugaaacacuuaaaaaua

SEQ ID NO: 4251736 - RNA, 70 nt, Staphylococcus aureus subsp. aureus MW2; identical to SEQ ID NO: 4250979

SEQ ID NO: 4251737 - RNA, 83 nt, Staphylococcus aureus subsp. aureus MW2; identical to SEQ ID NO: 4251271

SEQ ID NO: 4251738 - RNA, 92 nt, Staphylococcus aureus subsp. aureus MW2; identical to SEQ ID NO: 4251155

SEQ ID NO: 4251739 - RNA, 60 nt, Staphylococcus aureus subsp. aureus MW2
gaugguaucaauuugaugugugcguucaacaaacucgccaccuuuaaauaaaauaccauu

SEQ ID NO: 4251740 - RNA, 56 nt, Staphylococcus aureus subsp. aureus MW2
acuuaauggauaauaguguagcacgguaucgugaaacgcuguguuguucguaaagu

SEQ ID NO: 4251741 - RNA, 55 nt, Staphylococcus aureus subsp. aureus MW2; identical to SEQ ID NO: 4250895

SEQ ID NO: 4251742 - RNA, 80 nt, Staphylococcus aureus subsp. aureus MW2
aaccaucuaguuacuuuaugaucacuaaaaaugaugaagauuauuuuaugguuggugaugaugagguaaccaaagaaguu

SEQ ID NO: 4251743 - RNA, 58 nt, Staphylococcus aureus subsp. aureus MW2; identical to SEQ ID NO: 4251270

SEQ ID NO: 4251744 - RNA, 58 nt, Staphylococcus aureus subsp. aureus MW2
auaaagcaccacuaauguguaauugaucaacuaucaacuacgauuaguggugcuuuau

SEQ ID NO: 4251745 - RNA, 87 nt, Staphylococcus aureus subsp. aureus MW2
gaauccaugggauaaugguuuuaugacucaagaugcuaaaaacaauguuauuccaguauccaauggcgaccauuaucaaugguauuc

SEQ ID NO: 4251746 - RNA, 128 nt, Staphylococcus aureus subsp. aureus MW2
aucauugguggcauucguuugucgucuguguauguaauuaguugggcuacacuugcaaguuauguaggugcggguggauuaggugauuucauuuucaaugguuuaaauuuauaugauccacugaugau

SEQ ID NO: 4251747 - RNA, 62 nt, Staphylococcus aureus subsp. aureus MW2
aagucacauaccuagauauaaguacaacuuguauauuuuguacucuaauagguauguggcuu

SEQ ID NO: 4251748 - RNA, 57 nt, Staphylococcus aureus subsp. aureus MW2; identical to SEQ ID NO: 4250784

SEQ ID NO: 4251749 - RNA, 63 nt, Staphylococcus aureus subsp. aureus MW2
gugaacgugcauaugauauauacucacguuuauuaaaagaccguauuauuauguuagguucac

SEQ ID NO: 4251750 - RNA, 70 nt, Staphylococcus aureus subsp. aureus MW2
ugauucuacagaucaugguaacuuuaacgguauuucaaaaacuguuaauguaaaaccagauucagaauua

SEQ ID NO: 4251751 - RNA, 72 nt, Staphylococcus aureus subsp. aureus MW2
aauuggcggaucuggaaauuaucaauuuuaucaaacaaaugaugugauugagauaccagaugcgaaccaauu

SEQ ID NO: 4251752 - RNA, 92 nt, Staphylococcus aureus subsp. aureus MW2; identical to SEQ ID NO: 4251360

SEQ ID NO: 4251753 - RNA, 60 nt, Staphylococcus aureus subsp. aureus MW2
uguuugacuucaguacaauccugaagagaaaauuuguaacaggaugguggggucauaaca

SEQ ID NO: 4251754 - RNA, 83 nt, Staphylococcus aureus subsp. aureus MW2
gggagaaucuaaucaagauauuguugauauggcauuugcuuugaaagaaauggaugccgacaguauuccgauuaauuuuuugc

SEQ ID NO: 4251755 - RNA, 71 nt, Staphylococcus aureus subsp. aureus MW2; identical to SEQ ID NO: 4251103

SEQ ID NO: 4251756 - RNA, 62 nt, Staphylococcus aureus subsp. aureus MW2; identical to SEQ ID NO: 4251374

SEQ ID NO: 4251757 - RNA, 96 nt, Staphylococcus aureus subsp. aureus MW2; identical to SEQ ID NO: 4251129

SEQ ID NO: 4251758 - RNA, 94 nt, Staphylococcus aureus subsp. aureus MW2; identical to SEQ ID NO: 4250662

SEQ ID NO: 4251759 - RNA, 102 nt, Staphylococcus aureus subsp. aureus MW2
aguuauauaaauugguucuauaauaaaucggacugauagaaaaaguuuuuuacuuuucaucuguccgauuuuuugauuuuguuaggagagauguauaaaacu

SEQ ID NO: 4251760 - RNA, 75 nt, Staphylococcus aureus subsp. aureus MW2
gugguucucaaauaaaucggacaaauguuaaagauuuuacuuuuucauuuguucgauuuuuugacuuugaagcau

SEQ ID NO: 4251761 - RNA, 68 nt, Staphylococcus aureus subsp. aureus MW2
uuacuauugaugguuuuagcagcaucagguguaaugacuacagaugugucaacaacaguuaaugguga

SEQ ID NO: 4251762 - RNA, 57 nt, Staphylococcus aureus subsp. aureus MW2
aaaaugcuucguucaggaaggugucguaauuuaccuauuugcugaaugaagcauuuu

SEQ ID NO: 4251763 - RNA, 86 nt, Staphylococcus aureus subsp. aureus MW2
gauuuuaggugugucgauaucaaguuuaacguugccuauaacauuaauuguaggugcauuaguugguauuggcauagcuuucuauc

SEQ ID NO: 4251764 - RNA, 78 nt, Staphylococcus aureus subsp. aureus MW2
auuggugcgauuauuauguacguacuugggcuuguagaugauaucuacgauuugaaaccguauauaaaauuggcuggu

SEQ ID NO: 4251765 - RNA, 62 nt, Staphylococcus aureus subsp. aureus MW2
gcauuguauugacgacauaaguaccaaauuucacgugcuuucuuauguccaacgauacgugc

SEQ ID NO: 4251766 - RNA, 130 nt, Staphylococcus aureus subsp. aureus MW2
ucuacuagaagaaguaaaucaaguuuaaaugaagcaaacacagcuaugauaugaagguuuagcauauaacaugcaacauucguauaucauggcugugcuuuuuuaucuuuauaaaacaucaucuauuaga

SEQ ID NO: 4251767 - RNA, 55 nt, Staphylococcus aureus subsp. aureus MW2
ucucauaugaaaagcacgccugcuaucaaauucaggugugcuuuuuuagaugcga

SEQ ID NO: 4251768 - RNA, 86 nt, Staphylococcus aureus subsp. aureus MW2
auauuuaucgcgauuauuaccauauaaagcugcgauauaacuaaaaggauucggcuuuccuaauggucgugcuugcggauacauau

SEQ ID NO: 4251769 - RNA, 115 nt, Staphylococcus aureus subsp. aureus MW2
uugaggauaugcuagacaucaaauuuuauucguuggaugauauaaaugguuugucacuguuagacacauuaagucgcacgauagaaucagauaacaauggaaaagauuuccuuaa

SEQ ID NO: 4251770 - RNA, 82 nt, Staphylococcus aureus subsp. aureus MW2
uuaaaaucugacuugaaaggucauagcaauguucuauaccgauggaaugugcuuacuugccuuuuucuucacgacguuuuaa

SEQ ID NO: 4251771 - RNA, 64 nt, Staphylococcus aureus subsp. aureus N315; identical to SEQ ID NO: 4251369

SEQ ID NO: 4251772 - RNA, 74 nt, Staphylococcus aureus subsp. aureus N315; identical to SEQ ID NO: 4251650

SEQ ID NO: 4251773 - RNA, 65 nt, Staphylococcus aureus subsp. aureus N315; identical to SEQ ID NO: 4250948

SEQ ID NO: 4251774 - RNA, 72 nt, Staphylococcus aureus subsp. aureus N315
auugauuguguauuuagaagaugaacuagaauacuuagugauuuuuggugaaauuguaacuauauaaucgau

SEQ ID NO: 4251775 - RNA, 130 nt, Staphylococcus aureus subsp. aureus N315; identical to SEQ ID NO: 4251238

SEQ ID NO: 4251776 - RNA, 59 nt, Staphylococcus aureus subsp. aureus N315
aaugaggcuucacuaggacgagcauuaaaggauaauggcgucgauagagaagauuuguu

SEQ ID NO: 4251777 - RNA, 69 nt, Staphylococcus aureus subsp. aureus N315; identical to SEQ ID NO: 4250952

SEQ ID NO: 4251778 - RNA, 80 nt, Staphylococcus aureus subsp. aureus N315
guugaugcaccaauuguugaaggcaguuuuaucgcagcaguaaagcuaucaaucggcgguucaauugaugaugcauuagc

SEQ ID NO: 4251779 - RNA, 100 nt, Staphylococcus aureus subsp. aureus N315; identical to SEQ ID NO: 4250657

SEQ ID NO: 4251780 - RNA, 70 nt, Staphylococcus aureus subsp. aureus N315; identical to SEQ ID NO: 4250854

SEQ ID NO: 4251781 - RNA, 97 nt, Staphylococcus aureus subsp. aureus N315
agcuacaccuguacaauuuauuauuggauggcaauuuuauguaggugcuuauaaaaacuuaagaaaugguggcgccaauauggauguacuuguugcu

SEQ ID NO: 4251782 - RNA, 55 nt, Staphylococcus aureus subsp. aureus N315; identical to SEQ ID NO: 4251012

SEQ ID NO: 4251783 - RNA, 123 nt, Staphylococcus aureus subsp. aureus N315
gaguuguucagauuuguauuuugcgcuucuaguagcuugaauagugagcguauuauuauugaaaucgauacuaauaucuucuuuauuuacaccugcuaguucagcuucuaaguaauauaauuc

SEQ ID NO: 4251784 - RNA, 74 nt, Staphylococcus aureus subsp. aureus N315; identical to SEQ ID NO: 4250879

SEQ ID NO: 4251785 - RNA, 64 nt, Staphylococcus aureus subsp. aureus N315; identical to SEQ ID NO: 4251066

SEQ ID NO: 4251786 - RNA, 78 nt, Staphylococcus aureus subsp. aureus N315
cauaugaaucauuuguuccagguaaaauugugcaaucauuugacgcauuaauggacgccuuggacaaugaagauuaug

SEQ ID NO: 4251787 - RNA, 67 nt, Staphylococcus aureus subsp. aureus N315; identical to SEQ ID NO: 4251397

SEQ ID NO: 4251788 - RNA, 69 nt, Staphylococcus aureus subsp. aureus N315; identical to SEQ ID NO: 4250742

SEQ ID NO: 4251789 - RNA, 68 nt, Staphylococcus aureus subsp. aureus N315; identical to SEQ ID NO: 4251282

SEQ ID NO: 4251790 - RNA, 63 nt, Staphylococcus aureus subsp. aureus N315
cuauuggagugauaaugggugccaauaucggaacaacgguaacugcauuuauuaucgguauag

SEQ ID NO: 4251791 - RNA, 58 nt, Staphylococcus aureus subsp. aureus N315
aucgauggcuuuaaagauacgguaucaaacuacauaugaaccguuuaaaguaguugau

SEQ ID NO: 4251792 - RNA, 65 nt, Staphylococcus aureus subsp. aureus N315; identical to SEQ ID NO: 4251260

SEQ ID NO: 4251793 - RNA, 72 nt, Staphylococcus aureus subsp. aureus N315; identical to SEQ ID NO: 4250659

SEQ ID NO: 4251794 - RNA, 57 nt, Staphylococcus aureus subsp. aureus N315; identical to SEQ ID NO: 4251119

SEQ ID NO: 4251795 - RNA, 102 nt, Staphylococcus aureus subsp. aureus N315
uugcacguaguauugcggauaaaccugguuucgcuucaggucuuguaggugguauguuagcaauuucaggugguucaggauuuauuggugguauuauugcag

SEQ ID NO: 4251796 - RNA, 98 nt, Staphylococcus aureus subsp. aureus N315; identical to SEQ ID NO: 4251184

SEQ ID NO: 4251797 - RNA, 80 nt, Staphylococcus aureus subsp. aureus N315; identical to SEQ ID NO: 4251131

SEQ ID NO: 4251798 - RNA, 83 nt, Staphylococcus aureus subsp. aureus N315; identical to SEQ ID NO: 4250700

SEQ ID NO: 4251799 - RNA, 82 nt, Staphylococcus aureus subsp. aureus N315; identical to SEQ ID NO: 4250819

SEQ ID NO: 4251800 - RNA, 69 nt, Staphylococcus aureus subsp. aureus N315
ggcuaagacaaugcugacaauaaucacuguugcgauuguuacaauugaugucacugcauuauuaaagcc

SEQ ID NO: 4251801 - RNA, 68 nt, Staphylococcus aureus subsp. aureus N315; identical to SEQ ID NO: 4251291

SEQ ID NO: 4251802 - RNA, 71 nt, Staphylococcus aureus subsp. aureus N315; identical to SEQ ID NO: 4250751

SEQ ID NO: 4251803 - RNA, 117 nt, Staphylococcus aureus subsp. aureus N315
uuaauggcgauauuacuuucggcgcaaauuuacaaauugguuauuaugaucaaaagcaagcagaauuuaaaucuaguaaaacgauuuuagauuaugugugggaucaauauccguuaa

SEQ ID NO: 4251804 - RNA, 66 nt, Staphylococcus aureus subsp. aureus N315; identical to SEQ ID NO: 4251294

SEQ ID NO: 4251805 - RNA, 77 nt, Staphylococcus aureus subsp. aureus N315
gauaaaaaagcacagccaugauauacgaauguugcauguuauaugcuaaaccuucauaucauagcuguguuugauuc

SEQ ID NO: 4251806 - RNA, 63 nt, Staphylococcus aureus subsp. aureus N315; identical to SEQ ID NO: 4250980

SEQ ID NO: 4251807 - RNA, 125 nt, Staphylococcus aureus subsp. aureus N315
uuuugauugaauuagcauuuuacgaucauaaacagucauuauaauugaguauuugaacauaaaaauguaauuuuaucgucacaauuuggguguuugugauuguuuuugguaauuuaugauugaaa

SEQ ID NO: 4251808 - RNA, 69 nt, Staphylococcus aureus subsp. aureus N315
uuauuuaguauuuaugagcuaaucaaacaucauaauuuuuauggagaguuugauccuggcucaggauga

SEQ ID NO: 4251809 - RNA, 75 nt, Staphylococcus aureus subsp. aureus N315; identical to SEQ ID NO: 4251083

SEQ ID NO: 4251810 - RNA, 65 nt, Staphylococcus aureus subsp. aureus N315; identical to SEQ ID NO: 4250837

SEQ ID NO: 4251811 - RNA, 60 nt, Staphylococcus aureus subsp. aureus N315; identical to SEQ ID NO: 4251389

SEQ ID NO: 4251812 - RNA, 72 nt, Staphylococcus aureus subsp. aureus N315; identical to SEQ ID NO: 4251354

SEQ ID NO: 4251813 - RNA, 71 nt, Staphylococcus aureus subsp. aureus N315; identical to SEQ ID NO: 4250780

SEQ ID NO: 4251814 - RNA, 81 nt, Staphylococcus aureus subsp. aureus N315; identical to SEQ ID NO: 4251419

SEQ ID NO: 4251815 - RNA, 91 nt, Staphylococcus aureus subsp. aureus N315; identical to SEQ ID NO: 4251377

SEQ ID NO: 4251816 - RNA, 65 nt, Staphylococcus aureus subsp. aureus N315; identical to SEQ ID NO: 4251378

SEQ ID NO: 4251817 - RNA, 61 nt, Staphylococcus aureus subsp. aureus N315
guuacuuuaugauuacuaaaaaugaugaagauuauuuuaugguuggugaugaugagguaac

SEQ ID NO: 4251818 - RNA, 76 nt, Staphylococcus aureus subsp. aureus N315
aacguugagcaauaucauuggcgguucuuugucgccuacuguuggcaaaguggaucguaauggugaagucagcguu

SEQ ID NO: 4251819 - RNA, 67 nt, Staphylococcus aureus subsp. aureus N315; identical to SEQ ID NO: 4251227

SEQ ID NO: 4251820 - RNA, 56 nt, Staphylococcus aureus subsp. aureus N315; identical to SEQ ID NO: 4251147

SEQ ID NO: 4251821 - RNA, 65 nt, Staphylococcus aureus subsp. aureus N315
uagggcgauauuaaaagaugcaccaauaauuauuuuagaugaagcaacugcaaguauugacccug

SEQ ID NO: 4251822 - RNA, 81 nt, Staphylococcus aureus subsp. aureus N315
guuaggugcauuaacaguagcgauuggacgugugauagacgauucgauuguaguuguugaaaauauuuaucgacgcuuaac

SEQ ID NO: 4251823 - RNA, 74 nt, Staphylococcus aureus subsp. aureus N315; identical to SEQ ID NO: 4251113

SEQ ID NO: 4251824 - RNA, 63 nt, Staphylococcus aureus subsp. aureus N315
cugguucaagugguaacugcuacgucuuaaaugauggacguacuacguuacugcuugaggcag

SEQ ID NO: 4251825 - RNA, 69 nt, Staphylococcus aureus subsp. aureus N315
uguccaccagcuaaauuacuaccuucagucaacgucccuguuacugauacaguguuugacugguuucca

SEQ ID NO: 4251826 - RNA, 62 nt, Staphylococcus aureus subsp. aureus N315; identical to SEQ ID NO: 4250830

SEQ ID NO: 4251827 - RNA, 67 nt, Staphylococcus aureus subsp. aureus N315; identical to SEQ ID NO: 4250983

SEQ ID NO: 4251828 - RNA, 57 nt, Staphylococcus aureus subsp. aureus N315; identical to SEQ ID NO: 4250945

SEQ ID NO: 4251829 - RNA, 61 nt, Staphylococcus aureus subsp. aureus N315; identical to SEQ ID NO: 4251385

SEQ ID NO: 4251830 - RNA, 59 nt, Staphylococcus aureus subsp. aureus N315; identical to SEQ ID NO: 4251115

SEQ ID NO: 4251831 - RNA, 59 nt, Staphylococcus aureus subsp. aureus N315; identical to SEQ ID NO: 4251446

SEQ ID NO: 4251832 - RNA, 55 nt, Staphylococcus aureus subsp. aureus N315; identical to SEQ ID NO: 4251327

SEQ ID NO: 4251833 - RNA, 59 nt, Staphylococcus aureus subsp. aureus N315; identical to SEQ ID NO: 4251534

SEQ ID NO: 4251834 - RNA, 78 nt, Staphylococcus aureus subsp. aureus N315; identical to SEQ ID NO: 4251600

SEQ ID NO: 4251835 - RNA, 114 nt, Staphylococcus aureus subsp. aureus N315; identical to SEQ ID NO: 4251065

SEQ ID NO: 4251836 - RNA, 59 nt, Staphylococcus aureus subsp. aureus N315; identical to SEQ ID NO: 4251058

SEQ ID NO: 4251837 - RNA, 107 nt, Staphylococcus aureus subsp. aureus N315
gaugaaaauaaggcaauuauccuaauuucacaugauaugaaugaagucgcgcguuaugcagaugaagucaucguuaugaaagaagguaguauagugucgcaaacauc

SEQ ID NO: 4251838 - RNA, 129 nt, Staphylococcus aureus subsp. aureus N315; identical to SEQ ID NO: 4250718

SEQ ID NO: 4251839 - RNA, 63 nt, Staphylococcus aureus subsp. aureus N315; identical to SEQ ID NO: 4251114

SEQ ID NO: 4251840 - RNA, 128 nt, Staphylococcus aureus subsp. aureus N315; identical to SEQ ID NO: 4251138

SEQ ID NO: 4251841 - RNA, 71 nt, Staphylococcus aureus subsp. aureus N315; identical to SEQ ID NO: 4250709

SEQ ID NO: 4251842 - RNA, 58 nt, Staphylococcus aureus subsp. aureus N315; identical to SEQ ID NO: 4250826

SEQ ID NO: 4251843 - RNA, 96 nt, Staphylococcus aureus subsp. aureus N315; identical to SEQ ID NO: 4251361

SEQ ID NO: 4251844 - RNA, 71 nt, Staphylococcus aureus subsp. aureus N315; identical to SEQ ID NO: 4251505

SEQ ID NO: 4251845 - RNA, 62 nt, Staphylococcus aureus subsp. aureus N315
gacgaagguuauggcuguuugcuaaacccaaaugauacaucgaauggcacauaucauucguc

SEQ ID NO: 4251846 - RNA, 99 nt, Staphylococcus aureus subsp. aureus N315
aaucaaguuauuuaguuugauuuguacuucaucauauuguuguugcuuauaagcaauaucgugaugaagugcagcgccaucaacuugauuuucuugauu

SEQ ID NO: 4251847 - RNA, 55 nt, Staphylococcus aureus subsp. aureus N315; identical to SEQ ID NO: 4250845

SEQ ID NO: 4251848 - RNA, 79 nt, Staphylococcus aureus subsp. aureus N315
ucauagaugaugagccauuagcacguaaugaauuaacauauuuauuaaaugaaauuggugguuuugaagaaauuaauga

SEQ ID NO: 4251849 - RNA, 56 nt, Staphylococcus aureus subsp. aureus N315; identical to SEQ ID NO: 4250936

SEQ ID NO: 4251850 - RNA, 65 nt, Staphylococcus aureus subsp. aureus N315; identical to SEQ ID NO: 4250821

SEQ ID NO: 4251851 - RNA, 71 nt, Staphylococcus aureus subsp. aureus N315; identical to SEQ ID NO: 4251103

SEQ ID NO: 4251852 - RNA, 60 nt, Staphylococcus aureus subsp. aureus N315; identical to SEQ ID NO: 4251161

SEQ ID NO: 4251853 - RNA, 65 nt, Staphylococcus aureus subsp. aureus N315; identical to SEQ ID NO: 4250777

SEQ ID NO: 4251854 - RNA, 76 nt, Staphylococcus aureus subsp. aureus N315; identical to SEQ ID NO: 4250867

SEQ ID NO: 4251855 - RNA, 102 nt, Staphylococcus aureus subsp. aureus N315; identical to SEQ ID NO: 4250827

SEQ ID NO: 4251856 - RNA, 91 nt, Staphylococcus aureus subsp. aureus N315
cagcgaaaauauucauaaaggcacgcauacuuuguagucaguuaucuguucugacauauaaagcgugcgugcuuuuuugaagacauuguug

SEQ ID NO: 4251857 - RNA, 108 nt, Staphylococcus aureus subsp. aureus N315; identical to SEQ ID NO: 4250946

SEQ ID NO: 4251858 - RNA, 72 nt, Staphylococcus aureus subsp. aureus N315; identical to SEQ ID NO: 4250955

SEQ ID NO: 4251859 - RNA, 92 nt, Staphylococcus aureus subsp. aureus N315
aaauugauugggcguuuuaaaguacuagguccuggauuuucacgaucuacaggaaaugcauuuaaagacguuaaaaauuuaccaauccauuu

SEQ ID NO: 4251860 - RNA, 55 nt, Staphylococcus aureus subsp. aureus N315; identical to SEQ ID NO: 4251292

SEQ ID NO: 4251861 - RNA, 70 nt, Staphylococcus aureus subsp. aureus N315; identical to SEQ ID NO: 4250695

SEQ ID NO: 4251862 - RNA, 93 nt, Staphylococcus aureus subsp. aureus N315; identical to SEQ ID NO: 4250808

SEQ ID NO: 4251863 - RNA, 107 nt, Staphylococcus aureus subsp. aureus N315
uuacauuacugggacuuuccaaguuaaagauuuaccgaaugcgaauccuaaaucaaaugucauuccaaaagguaaauauuuaguucuuggagauaaucgugaaguaa

SEQ ID NO: 4251864 - RNA, 55 nt, Staphylococcus aureus subsp. aureus N315; identical to SEQ ID NO: 4251319

SEQ ID NO: 4251865 - RNA, 82 nt, Staphylococcus aureus subsp. aureus N315
uugcaguugaacuuaauaaagauauuuauacagggcuauuaucuaauauggcuucaaugguauuuuuauuaggugaacucaa

SEQ ID NO: 4251866 - RNA, 59 nt, Staphylococcus aureus subsp. aureus N315; identical to SEQ ID NO: 4250681

SEQ ID NO: 4251867 - RNA, 92 nt, Staphylococcus aureus subsp. aureus N315; identical to SEQ ID NO: 4250678

SEQ ID NO: 4251868 - RNA, 85 nt, Staphylococcus aureus subsp. aureus N315; identical to SEQ ID NO: 4250915

SEQ ID NO: 4251869 - RNA, 60 nt, Staphylococcus aureus subsp. aureus N315; identical to SEQ ID NO: 4250766

SEQ ID NO: 4251870 - RNA, 66 nt, Staphylococcus aureus subsp. aureus N315; identical to SEQ ID NO: 4250954

SEQ ID NO: 4251871 - RNA, 84 nt, Staphylococcus aureus subsp. aureus N315; identical to SEQ ID NO: 4250774

SEQ ID NO: 4251872 - RNA, 120 nt, Staphylococcus aureus subsp. aureus N315; identical to SEQ ID NO: 4250697

SEQ ID NO: 4251873 - RNA, 108 nt, Staphylococcus aureus subsp. aureus N315; identical to SEQ ID NO: 4251384

SEQ ID NO: 4251874 - RNA, 71 nt, Staphylococcus aureus subsp. aureus N315
guucuauaauaaaucggacugauggaaaaaaguauuuuacuuuucaucuguccgauuuuuugauuuugaau

SEQ ID NO: 4251875 - RNA, 72 nt, Staphylococcus aureus subsp. aureus N315; identical to SEQ ID NO: 4250840

SEQ ID NO: 4251876 - RNA, 83 nt, Staphylococcus aureus subsp. aureus N315; identical to SEQ ID NO: 4250694

SEQ ID NO: 4251877 - RNA, 61 nt, Staphylococcus aureus subsp. aureus N315; identical to SEQ ID NO: 4251102

SEQ ID NO: 4251878 - RNA, 81 nt, Staphylococcus aureus subsp. aureus N315
guuucuuuauaacuuuccuuaaauguuaauacuucgauuagauaacucuuguuaagauuuugaugaaaguaaggagggagc

SEQ ID NO: 4251879 - RNA, 81 nt, Staphylococcus aureus subsp. aureus N315; identical to SEQ ID NO: 4250937

SEQ ID NO: 4251880 - RNA, 60 nt, Staphylococcus aureus subsp. aureus N315; identical to SEQ ID NO: 4251573

SEQ ID NO: 4251881 - RNA, 75 nt, Staphylococcus aureus subsp. aureus N315; identical to SEQ ID NO: 4250880

SEQ ID NO: 4251882 - RNA, 76 nt, Staphylococcus aureus subsp. aureus N315; identical to SEQ ID NO: 4251396

SEQ ID NO: 4251883 - RNA, 62 nt, Staphylococcus aureus subsp. aureus N315; identical to SEQ ID NO: 4250925

SEQ ID NO: 4251884 - RNA, 61 nt, Staphylococcus aureus subsp. aureus N315
gugauauuauuguuacaaaaggcccugucauguggggauuuuuuggucauuguaguaucgc

SEQ ID NO: 4251885 - RNA, 71 nt, Staphylococcus aureus subsp. aureus N315
uuaaauauaacaacgccacauaagauauaauuugguguuacgcaucuuauguggcguuggucguuauuuga

SEQ ID NO: 4251886 - RNA, 86 nt, Staphylococcus aureus subsp. aureus N315; identical to SEQ ID NO: 4251440

SEQ ID NO: 4251887 - RNA, 92 nt, Staphylococcus aureus subsp. aureus N315
uguuuuuaaaacgaaauucaaauccauuuauugcggcauuaucagcagaagguauugugcccaaauuaguauggacgaaacgcauagaaaca

SEQ ID NO: 4251888 - RNA, 58 nt, Staphylococcus aureus subsp. aureus N315; identical to SEQ ID NO: 4250901

SEQ ID NO: 4251889 - RNA, 74 nt, Staphylococcus aureus subsp. aureus N315; identical to SEQ ID NO: 4251011

SEQ ID NO: 4251890 - RNA, 64 nt, Staphylococcus aureus subsp. aureus N315; identical to SEQ ID NO: 4251001

SEQ ID NO: 4251891 - RNA, 58 nt, Staphylococcus aureus subsp. aureus N315; identical to SEQ ID NO: 4250671

SEQ ID NO: 4251892 - RNA, 70 nt, Staphylococcus aureus subsp. aureus N315; identical to SEQ ID NO: 4250979

SEQ ID NO: 4251893 - RNA, 107 nt, Staphylococcus aureus subsp. aureus N315; identical to SEQ ID NO: 4250904

SEQ ID NO: 4251894 - RNA, 70 nt, Staphylococcus aureus subsp. aureus N315; identical to SEQ ID NO: 4250847

SEQ ID NO: 4251895 - RNA, 115 nt, Staphylococcus aureus subsp. aureus N315; identical to SEQ ID NO: 4251326

SEQ ID NO: 4251896 - RNA, 60 nt, Staphylococcus aureus subsp. aureus N315; identical to SEQ ID NO: 4251314

SEQ ID NO: 4251897 - RNA, 80 nt, Staphylococcus aureus subsp. aureus N315; identical to SEQ ID NO: 4250706

SEQ ID NO: 4251898 - RNA, 85 nt, Staphylococcus aureus subsp. aureus N315; identical to SEQ ID NO: 4250943

SEQ ID NO: 4251899 - RNA, 65 nt, Staphylococcus aureus subsp. aureus N315; identical to SEQ ID NO: 4251054

SEQ ID NO: 4251900 - RNA, 65 nt, Staphylococcus aureus subsp. aureus N315; identical to SEQ ID NO: 4251210

SEQ ID NO: 4251901 - RNA, 58 nt, Staphylococcus aureus subsp. aureus N315
gaugagagugacacacauuuaucauauaaaaugaugaugaaagcguguuacucuuauu

SEQ ID NO: 4251902 - RNA, 67 nt, Staphylococcus aureus subsp. aureus N315
gacauuaaaagcuucuaacaugauacggaauaugagguuccuguaucacauuagaagcuuuuuuguu

SEQ ID NO: 4251903 - RNA, 60 nt, Staphylococcus aureus subsp. aureus N315; identical to SEQ ID NO: 4250805

SEQ ID NO: 4251904 - RNA, 70 nt, Staphylococcus aureus subsp. aureus N315
ugaaauuaagaauguuguaauaaccgcacgauggugugguguauaagaugcaauaucuuuagaaauuuca

SEQ ID NO: 4251905 - RNA, 93 nt, Staphylococcus aureus subsp. aureus N315; identical to SEQ ID NO: 4250849

SEQ ID NO: 4251906 - RNA, 82 nt, Staphylococcus aureus subsp. aureus N315; identical to SEQ ID NO: 4251370

SEQ ID NO: 4251907 - RNA, 100 nt, Staphylococcus aureus subsp. aureus N315
uaucuuugaagaauacuaugcugcaggucaacguuuaaaagaauuuguaacagacacaucaaaaaucuuagacgaugcauuuguagcagaugaaaaggua

SEQ ID NO: 4251908 - RNA, 80 nt, Staphylococcus aureus subsp. aureus N315; identical to SEQ ID NO: 4250968

SEQ ID NO: 4251909 - RNA, 58 nt, Staphylococcus aureus subsp. aureus N315; identical to SEQ ID NO: 4251158

SEQ ID NO: 4251910 - RNA, 57 nt, Staphylococcus aureus subsp. aureus N315; identical to SEQ ID NO: 4251307

SEQ ID NO: 4251911 - RNA, 71 nt, Staphylococcus aureus subsp. aureus N315; identical to SEQ ID NO: 4250938

SEQ ID NO: 4251912 - RNA, 63 nt, Staphylococcus aureus subsp. aureus N315
uugcaguuauggaagcaaguuuaauuaguaguaugcguacugcagcaguuucagugauugcag

SEQ ID NO: 4251913 - RNA, 65 nt, Staphylococcus aureus subsp. aureus N315; identical to SEQ ID NO: 4251225

SEQ ID NO: 4251914 - RNA, 61 nt, Staphylococcus aureus subsp. aureus N315
gcucauuauuagucgauuacauacugacugucgcuguuaguauaucaucuggugcugaugc

SEQ ID NO: 4251915 - RNA, 62 nt, Staphylococcus aureus subsp. aureus N315; identical to SEQ ID NO: 4251374

SEQ ID NO: 4251916 - RNA, 91 nt, Staphylococcus aureus subsp. aureus N315
gucaugucccauauuauuuaucaaaugugcuucuacuuuccaaccuacaccuuuaugugacguagauugaucaaguaauguacgauaugau

SEQ ID NO: 4251917 - RNA, 94 nt, Staphylococcus aureus subsp. aureus N315; identical to SEQ ID NO: 4250662

SEQ ID NO: 4251918 - RNA, 76 nt, Staphylococcus aureus subsp. aureus N315
gucgcaaauauguugcaagaacguuuagggacgggcaaaguugccucuauggaucaacuugcagcauguucuggau

SEQ ID NO: 4251919 - RNA, 70 nt, Staphylococcus aureus subsp. aureus N315; identical to SEQ ID NO: 4250770

SEQ ID NO: 4251920 - RNA, 69 nt, Staphylococcus aureus subsp. aureus N315; identical to SEQ ID NO: 4251349

SEQ ID NO: 4251921 - RNA, 73 nt, Staphylococcus aureus subsp. aureus N315
aaauaaauucacaaaauuaggcauucaucuaacgacccaaauuauauggguguuggaagaaugccuuuuauuu

SEQ ID NO: 4251922 - RNA, 56 nt, Staphylococcus aureus subsp. aureus N315
auagugaguuuguuacauauugcggugauauuaccguuaauauucgcacucauuau

SEQ ID NO: 4251923 - RNA, 79 nt, Staphylococcus aureus subsp. aureus N315
uauaguaugucaagguuuugacuuauugcuuuauuccgcucuggaugugcaauaaucgguacaaagccuuuacucugua

SEQ ID NO: 4251924 - RNA, 68 nt, Staphylococcus aureus subsp. aureus N315
gcgggacggaaaugauaaagaacgacuaaugauugauuauguagcgauucuuuaucauuagucaaagc

SEQ ID NO: 4251925 - RNA, 96 nt, Staphylococcus aureus subsp. aureus N315; identical to SEQ ID NO: 4251090

SEQ ID NO: 4251926 - RNA, 57 nt, Staphylococcus aureus subsp. aureus N315
gaguagcucgcaaaguaugaguggaucagaaucaacgucaacaagugugagcgauuc

SEQ ID NO: 4251927 - RNA, 55 nt, Staphylococcus aureus subsp. aureus N315; identical to SEQ ID NO: 4251148

SEQ ID NO: 4251928 - RNA, 59 nt, Staphylococcus aureus subsp. aureus N315; identical to SEQ ID NO: 4251461

SEQ ID NO: 4251929 - RNA, 58 nt, Staphylococcus aureus subsp. aureus N315; identical to SEQ ID NO: 4251070

SEQ ID NO: 4251930 - RNA, 77 nt, Staphylococcus aureus subsp. aureus N315; identical to SEQ ID NO: 4251002

SEQ ID NO: 4251931 - RNA, 90 nt, Staphylococcus aureus subsp. aureus N315; identical to SEQ ID NO: 4250899

SEQ ID NO: 4251932 - RNA, 73 nt, Staphylococcus aureus subsp. aureus N315; identical to SEQ ID NO: 4251479

SEQ ID NO: 4251933 - RNA, 81 nt, Staphylococcus aureus subsp. aureus N315; identical to SEQ ID NO: 4251398

SEQ ID NO: 4251934 - RNA, 73 nt, Staphylococcus aureus subsp. aureus N315
ucauuugcgcaauuggaaaugguuuagucgcaacacccggccuuacaauugcaauuuucaguaugccaaauga

SEQ ID NO: 4251935 - RNA, 58 nt, Staphylococcus aureus subsp. aureus N315
accauugaugcgacgcgauuuagauguacuuauagcuaaauuaaaucaaaucgauggu

SEQ ID NO: 4251936 - RNA, 57 nt, Staphylococcus aureus subsp. aureus N315; identical to SEQ ID NO: 4250934

SEQ ID NO: 4251937 - RNA, 86 nt, Staphylococcus aureus subsp. aureus N315; identical to SEQ ID NO: 4251000

SEQ ID NO: 4251938 - RNA, 92 nt, Staphylococcus aureus subsp. aureus N315
gguaugggagaaucuaaucaagauauuguugauauggcauuugcuuuaaaagaaauggaugccgacaguauuccgauuaauuuuuugcaucc

SEQ ID NO: 4251939 - RNA, 109 nt, Staphylococcus aureus subsp. aureus N315
uguuacuuguguugcguuugacgguuguucuguuacuguugcguuauaugauugaguuucuucuauaugauuaacguuaguagcaguuguuuguguuucacuuguuuua

SEQ ID NO: 4251940 - RNA, 78 nt, Staphylococcus aureus subsp. aureus N315
uuauauuggcaguaguugacugaacgaaaaugcacuuguaacaaguuuuuucaauucuagucaggggccccaacauag

SEQ ID NO: 4251941 - RNA, 71 nt, Staphylococcus aureus subsp. aureus N315; identical to SEQ ID NO: 4251540

SEQ ID NO: 4251942 - RNA, 106 nt, Staphylococcus aureus subsp. aureus N315
uaauacaacuugucuaauugauuaaggcgaauggcuuucaauaaaaagacucguuuuuuauagugaagguaguuugaaaauaaugaauauaaagaugaagguauua

SEQ ID NO: 4251943 - RNA, 66 nt, Staphylococcus aureus subsp. aureus N315; identical to SEQ ID NO: 4251627

SEQ ID NO: 4251944 - RNA, 59 nt, Staphylococcus aureus subsp. aureus N315; identical to SEQ ID NO: 4250800

SEQ ID NO: 4251945 - RNA, 65 nt, Staphylococcus aureus subsp. aureus N315; identical to SEQ ID NO: 4251053

SEQ ID NO: 4251946 - RNA, 66 nt, Staphylococcus aureus subsp. aureus N315; identical to SEQ ID NO: 4251255

SEQ ID NO: 4251947 - RNA, 65 nt, Staphylococcus aureus subsp. aureus N315; identical to SEQ ID NO: 4250876

SEQ ID NO: 4251948 - RNA, 62 nt, Staphylococcus aureus subsp. aureus N315; identical to SEQ ID NO: 4251403

SEQ ID NO: 4251949 - RNA, 109 nt, Staphylococcus aureus subsp. aureus N315; identical to SEQ ID NO: 4251121

SEQ ID NO: 4251950 - RNA, 60 nt, Staphylococcus aureus subsp. aureus N315; identical to SEQ ID NO: 4251194

SEQ ID NO: 4251951 - RNA, 86 nt, Staphylococcus aureus subsp. aureus N315; identical to SEQ ID NO: 4251587

SEQ ID NO: 4251952 - RNA, 64 nt, Staphylococcus aureus subsp. aureus N315
cguuaauauucaauacaacgauggcuacgacuuaaugauagaccagcguuuuauugaaaugacg

SEQ ID NO: 4251953 - RNA, 76 nt, Staphylococcus aureus subsp. aureus N315; identical to SEQ ID NO: 4250991

SEQ ID NO: 4251954 - RNA, 77 nt, Staphylococcus aureus subsp. aureus N315; identical to SEQ ID NO: 4250982

SEQ ID NO: 4251955 - RNA, 113 nt, Staphylococcus aureus subsp. aureus N315; identical to SEQ ID NO: 4251193

SEQ ID NO: 4251956 - RNA, 92 nt, Staphylococcus aureus subsp. aureus N315; identical to SEQ ID NO: 4250910

SEQ ID NO: 4251957 - RNA, 64 nt, Staphylococcus aureus subsp. aureus N315; identical to SEQ ID NO: 4250825

SEQ ID NO: 4251958 - RNA, 103 nt, Staphylococcus aureus subsp. aureus N315; identical to SEQ ID NO: 4251015

SEQ ID NO: 4251959 - RNA, 62 nt, Staphylococcus aureus subsp. aureus N315; identical to SEQ ID NO: 4251142

SEQ ID NO: 4251960 - RNA, 57 nt, Staphylococcus aureus subsp. aureus N315; identical to SEQ ID NO: 4251035

SEQ ID NO: 4251961 - RNA, 74 nt, Staphylococcus aureus subsp. aureus N315
uauuagcaggugguguguucuguuguugauuauuuugguuguuuguugacgauugacugccaccaccgugagua

SEQ ID NO: 4251962 - RNA, 110 nt, Staphylococcus aureus subsp. aureus N315
gaaaauaaaaauggagcaccuguaaaugcacugcuuauuaccaauauauuaguacaauuauuuuuaauaaguaugcuauuuacacagagugcguaucaauuugcauuuuc

SEQ ID NO: 4251963 - RNA, 76 nt, Staphylococcus aureus subsp. aureus N315; identical to SEQ ID NO: 4251444

SEQ ID NO: 4251964 - RNA, 130 nt, Staphylococcus aureus subsp. aureus N315
gugaagaucgaaugauacuuuuacaacucaaucauauaucaaaaucguucgauggugaagauauauuuacugauguugauuuugaaguaaaaacuggugaacgaauugguaucguaggaagaaauggcgc

SEQ ID NO: 4251965 - RNA, 130 nt, Staphylococcus aureus subsp. aureus N315
ucgacgaaguuaacacaaaagcauucgaagguacauuauuagcgcauacugauggugguguuccuaacaugguagugaacauuccacaauuagaugaagaaacuuucgguuaugucguauacuucuucga

SEQ ID NO: 4251966 - RNA, 72 nt, Staphylococcus aureus subsp. aureus N315; identical to SEQ ID NO: 4250920

SEQ ID NO: 4251967 - RNA, 55 nt, Staphylococcus aureus subsp. aureus N315; identical to SEQ ID NO: 4251030

SEQ ID NO: 4251968 - RNA, 64 nt, Staphylococcus aureus subsp. aureus N315; identical to SEQ ID NO: 4250798

SEQ ID NO: 4251969 - RNA, 88 nt, Staphylococcus aureus subsp. aureus N315; identical to SEQ ID NO: 4251655

SEQ ID NO: 4251970 - RNA, 63 nt, Staphylococcus aureus subsp. aureus N315; identical to SEQ ID NO: 4251707

SEQ ID NO: 4251971 - RNA, 79 nt, Staphylococcus aureus subsp. aureus N315
cuguuacugaauauuuguaagggucuguuaguacuacuuugauagugaacuuaacagguauugcaaauucuuugugcag

SEQ ID NO: 4251972 - RNA, 111 nt, Staphylococcus aureus subsp. aureus N315
aaacaauaccugauagcgaauucgaugaauucagacaucaucguggcgcaacauccuaucauccaaaaaugauguuaaaaaucaucuuauaugcauauacucaaucuguuu

SEQ ID NO: 4251973 - RNA, 73 nt, Staphylococcus aureus subsp. aureus N315; identical to SEQ ID NO: 4251107

SEQ ID NO: 4251974 - RNA, 96 nt, Staphylococcus aureus subsp. aureus N315; identical to SEQ ID NO: 4250838

SEQ ID NO: 4251975 - RNA, 57 nt, Staphylococcus aureus subsp. aureus N315; identical to SEQ ID NO: 4250781

SEQ ID NO: 4251976 - RNA, 63 nt, Staphylococcus aureus subsp. aureus N315
guuaaagccuugauugucagcacuugggaaaauaucaaagguguaauacaaggggcuauuaau

SEQ ID NO: 4251977 - RNA, 63 nt, Staphylococcus aureus subsp. aureus N315; identical to SEQ ID NO: 4250889

SEQ ID NO: 4251978 - RNA, 55 nt, Staphylococcus aureus subsp. aureus N315; identical to SEQ ID NO: 4250895

SEQ ID NO: 4251979 - RNA, 79 nt, Staphylococcus aureus subsp. aureus N315; identical to SEQ ID NO: 4250776

SEQ ID NO: 4251980 - RNA, 91 nt, Staphylococcus aureus subsp. aureus N315
cgucaauuuaucggcaaugaaccauuugcgguauuauuaggugacgauauuguugaaucugaagugccagcagugaaacaguugauugacg

SEQ ID NO: 4251981 - RNA, 76 nt, Staphylococcus aureus subsp. aureus N315
cauaauagcuaugaccauaugccauguuagcauaugcgcuaugauccacauugggcauaaucacagcuaauuugug

SEQ ID NO: 4251982 - RNA, 70 nt, Staphylococcus aureus subsp. aureus N315; identical to SEQ ID NO: 4250860

SEQ ID NO: 4251983 - RNA, 62 nt, Staphylococcus aureus subsp. aureus N315; identical to SEQ ID NO: 4251236

SEQ ID NO: 4251984 - RNA, 78 nt, Staphylococcus aureus subsp. aureus N315
aaugugauugcagcuuuaagugauucugagucaguuuuaagccaacuuuuucaguaucgcuuugaagaaaaucaaauu

SEQ ID NO: 4251985 - RNA, 59 nt, Staphylococcus aureus subsp. aureus N315; identical to SEQ ID NO: 4250906

SEQ ID NO: 4251986 - RNA, 63 nt, Staphylococcus aureus subsp. aureus N315; identical to SEQ ID NO: 4250714

SEQ ID NO: 4251987 - RNA, 59 nt, Staphylococcus aureus subsp. aureus N315; identical to SEQ ID NO: 4250717

SEQ ID NO: 4251988 - RNA, 80 nt, Staphylococcus aureus subsp. aureus N315
ugaguguugauaauguuacgauacuuuccucagcacaugauaaugcuguaaaaguaucuccaauaguaucugucaacuua

SEQ ID NO: 4251989 - RNA, 77 nt, Staphylococcus aureus subsp. aureus N315; identical to SEQ ID NO: 4250913

SEQ ID NO: 4251990 - RNA, 80 nt, Staphylococcus aureus subsp. aureus N315
uugacgguuuaguaacuaaauuacaagcugcauuaauugauaaucaagcagcaauugcugaauuagauacuaaagcucaa

SEQ ID NO: 4251991 - RNA, 68 nt, Staphylococcus aureus subsp. aureus N315; identical to SEQ ID NO: 4251338

SEQ ID NO: 4251992 - RNA, 92 nt, Staphylococcus aureus subsp. aureus N315; identical to SEQ ID NO: 4251348

SEQ ID NO: 4251993 - RNA, 60 nt, Staphylococcus aureus subsp. aureus N315
ucaguuaccacuuuuuauuguggaaaaugguuuuggugcaguugaugaagugguagaugg

SEQ ID NO: 4251994 - RNA, 73 nt, Staphylococcus aureus subsp. aureus N315; identical to SEQ ID NO: 4251088

SEQ ID NO: 4251995 - RNA, 56 nt, Staphylococcus aureus subsp. aureus N315; identical to SEQ ID NO: 4250707

SEQ ID NO: 4251996 - RNA, 73 nt, Staphylococcus aureus subsp. aureus N315; identical to SEQ ID NO: 4251702

SEQ ID NO: 4251997 - RNA, 83 nt, Staphylococcus aureus subsp. aureus N315; identical to SEQ ID NO: 4251195

SEQ ID NO: 4251998 - RNA, 81 nt, Staphylococcus aureus subsp. aureus N315; identical to SEQ ID NO: 4251240

SEQ ID NO: 4251999 - RNA, 64 nt, Staphylococcus aureus subsp. aureus N315; identical to SEQ ID NO: 4251171

SEQ ID NO: 4252000 - RNA, 59 nt, Staphylococcus aureus subsp. aureus N315; identical to SEQ ID NO: 4251228

SEQ ID NO: 4252001 - RNA, 130 nt, Staphylococcus aureus subsp. aureus N315
gacuaaaaaacuuccauuggcauguauguuguaaaggugcauguaauguugaacgccaaaugauacggcguucagauuacauuagcaucuauacguuaacagcauaaccaauggaaguuuucuucgaguc

SEQ ID NO: 4252002 - RNA, 65 nt, Staphylococcus aureus subsp. aureus N315; identical to SEQ ID NO: 4250809

SEQ ID NO: 4252003 - RNA, 129 nt, Staphylococcus aureus subsp. aureus N315; identical to SEQ ID NO: 4250882

SEQ ID NO: 4252004 - RNA, 62 nt, Staphylococcus aureus subsp. aureus N315; identical to SEQ ID NO: 4251538

SEQ ID NO: 4252005 - RNA, 55 nt, Staphylococcus aureus subsp. aureus N315; identical to SEQ ID NO: 4251163

SEQ ID NO: 4252006 - RNA, 118 nt, Staphylococcus aureus subsp. aureus N315
acauccauuaaauuaaucaugacaucaauaaaaagcgaccaguucgcaguuuacaauucguaacacugcaaaauuggucgcuuuauuuuguauguuauucgauuauuaaauaugaugu

SEQ ID NO: 4252007 - RNA, 83 nt, Staphylococcus aureus subsp. aureus N315; identical to SEQ ID NO: 4251271

SEQ ID NO: 4252008 - RNA, 65 nt, Staphylococcus aureus subsp. aureus N315; identical to SEQ ID NO: 4250704

SEQ ID NO: 4252009 - RNA, 116 nt, Staphylococcus aureus subsp. aureus N315
gcgauguuagagguaaaggucugagcauugguauugauauuguuuccgacaaaaaacucaaaacacgugaugccagugcggcacuuaaaauuuguaauuacugcuuugagcauggc

SEQ ID NO: 4252010 - RNA, 82 nt, Staphylococcus aureus subsp. aureus N315
ugguauaaaucugauggaucuggaucuguaccuccugcccaugaucugaaguacacuuccauaucuuuagaugcauuugcua

SEQ ID NO: 4252011 - RNA, 63 nt, Staphylococcus aureus subsp. aureus N315; identical to SEQ ID NO: 4251043

SEQ ID NO: 4252012 - RNA, 77 nt, Staphylococcus aureus subsp. aureus N315; identical to SEQ ID NO: 4251038

SEQ ID NO: 4252013 - RNA, 68 nt, Staphylococcus aureus subsp. aureus N315; identical to SEQ ID NO: 4250977

SEQ ID NO: 4252014 - RNA, 57 nt, Staphylococcus aureus subsp. aureus N315; identical to SEQ ID NO: 4250784

SEQ ID NO: 4252015 - RNA, 58 nt, Staphylococcus aureus subsp. aureus N315; identical to SEQ ID NO: 4251062

SEQ ID NO: 4252016 - RNA, 77 nt, Staphylococcus aureus subsp. aureus N315; identical to SEQ ID NO: 4250795

SEQ ID NO: 4252017 - RNA, 65 nt, Staphylococcus aureus subsp. aureus N315; identical to SEQ ID NO: 4250935

SEQ ID NO: 4252018 - RNA, 92 nt, Staphylococcus aureus subsp. aureus N315
aggcgcaaaagauuuagcaauaauagguaguauguuaacaccaacagcuguuguaauaauaucagcuucuagaauugcuuguuucaacgcuu

SEQ ID NO: 4252019 - RNA, 129 nt, Staphylococcus aureus subsp. aureus N315; identical to SEQ ID NO: 4251345

SEQ ID NO: 4252020 - RNA, 66 nt, Staphylococcus aureus subsp. aureus N315; identical to SEQ ID NO: 4250734

SEQ ID NO: 4252021 - RNA, 58 nt, Staphylococcus aureus subsp. aureus N315; identical to SEQ ID NO: 4251270

SEQ ID NO: 4252022 - RNA, 107 nt, Staphylococcus aureus subsp. aureus N315; identical to SEQ ID NO: 4250856

SEQ ID NO: 4252023 - RNA, 72 nt, Staphylococcus aureus subsp. aureus N315; identical to SEQ ID NO: 4251013

SEQ ID NO: 4252024 - RNA, 97 nt, Staphylococcus aureus subsp. aureus N315; identical to SEQ ID NO: 4250708

SEQ ID NO: 4252025 - RNA, 59 nt, Staphylococcus aureus subsp. aureus N315; identical to SEQ ID NO: 4250916

SEQ ID NO: 4252026 - RNA, 78 nt, Staphylococcus aureus subsp. aureus N315; identical to SEQ ID NO: 4251764

SEQ ID NO: 4252027 - RNA, 83 nt, Staphylococcus aureus subsp. aureus N315
gcuuuugcgcaugcauaaaagccccuaacaaccugaggucacugcgcuucgguucgccugcgcuuuugcgcaugcauaaaagc

SEQ ID NO: 4252028 - RNA, 60 nt, Staphylococcus aureus subsp. aureus N315
acgcucucaguagucaucuuuaaaucguuucuuuuagagaugacuucauuuugagagcgu

SEQ ID NO: 4252029 - RNA, 95 nt, Staphylococcus aureus subsp. aureus N315
gagccugagucacugucugaauccgaauccggauccgggucugggcuugguuccgguucugggucuggacuugguucuggaucuggcguugguuc

SEQ ID NO: 4252030 - RNA, 58 nt, Staphylococcus aureus subsp. aureus N315; identical to SEQ ID NO: 4251313

SEQ ID NO: 4252031 - RNA, 89 nt, Staphylococcus aureus subsp. aureus N315
uauuuuuggcagccauaauaccagcgauuugagcaguguucaauacauugccuuugguauugguguuauuagaaaucugcuuaaaaaua

SEQ ID NO: 4252032 - RNA, 81 nt, Staphylococcus aureus subsp. aureus N315; identical to SEQ ID NO: 4251029

SEQ ID NO: 4252033 - RNA, 118 nt, Staphylococcus aureus subsp. aureus N315
acaucauauuuaauaaucgaauaacauacaaaauaaagcgaccaauuuugcaguguuacgaauuguaaacugcgaacuggucgcuuuuuauugaugucaugauuaauuuaauggaugu

SEQ ID NO: 4252034 - RNA, 57 nt, Staphylococcus aureus subsp. aureus N315; identical to SEQ ID NO: 4250710

SEQ ID NO: 4252035 - RNA, 70 nt, Staphylococcus aureus subsp. aureus N315; identical to SEQ ID NO: 4250905

SEQ ID NO: 4252036 - RNA, 59 nt, Staphylococcus aureus subsp. aureus N315; identical to SEQ ID NO: 4250877

SEQ ID NO: 4252037 - RNA, 64 nt, Staphylococcus aureus subsp. aureus N315
guaacuuuauuugucauaaauggagaucauuuugaagauggucaagcguuauacaaaaaguuac

SEQ ID NO: 4252038 - RNA, 71 nt, Staphylococcus aureus subsp. aureus N315
uaauauuugauuuugaugagcgugcaauacuuaauaguaauugagcguaugccgcuuucgaaauaugguua

SEQ ID NO: 4252039 - RNA, 81 nt, Staphylococcus aureus subsp. aureus N315; identical to SEQ ID NO: 4250737

SEQ ID NO: 4252040 - RNA, 92 nt, Staphylococcus aureus subsp. aureus N315; identical to SEQ ID NO: 4251155

SEQ ID NO: 4252041 - RNA, 119 nt, Staphylococcus aureus subsp. aureus N315; identical to SEQ ID NO: 4251405

SEQ ID NO: 4252042 - RNA, 85 nt, Staphylococcus aureus subsp. aureus N315; identical to SEQ ID NO: 4251512

SEQ ID NO: 4252043 - RNA, 76 nt, Staphylococcus aureus subsp. aureus N315; identical to SEQ ID NO: 4250917

SEQ ID NO: 4252044 - RNA, 88 nt, Staphylococcus aureus subsp. aureus N315; identical to SEQ ID NO: 4251435

SEQ ID NO: 4252045 - RNA, 64 nt, Staphylococcus aureus subsp. aureus N315
aagcaugauacucaauaaaauuggaacacgaaauggugaacuaaauugaaugagugucaugcuu

SEQ ID NO: 4252046 - RNA, 63 nt, Staphylococcus aureus subsp. aureus N315; identical to SEQ ID NO: 4251350

SEQ ID NO: 4252047 - RNA, 69 nt, Staphylococcus aureus subsp. aureus N315; identical to SEQ ID NO: 4251523

SEQ ID NO: 4252048 - RNA, 83 nt, Staphylococcus aureus subsp. aureus N315
gcuggaacguuuaaucaagcuaugauggaauuaggggcauuaauuuguacaccaaaaaauccauuaugcuuauuuuguccagu

SEQ ID NO: 4252049 - RNA, 60 nt, Staphylococcus aureus subsp. aureus N315
ugucuggugaguuagaagugaaucaacugaaaaaaguugaaguagaagauuuacuaggca

SEQ ID NO: 4252050 - RNA, 104 nt, Staphylococcus aureus subsp. aureus N315; identical to SEQ ID NO: 4251450

SEQ ID NO: 4252051 - RNA, 73 nt, Staphylococcus aureus subsp. aureus N315; identical to SEQ ID NO: 4251393

SEQ ID NO: 4252052 - RNA, 59 nt, Staphylococcus aureus subsp. aureus N315; identical to SEQ ID NO: 4251180

SEQ ID NO: 4252053 - RNA, 130 nt, Staphylococcus aureus subsp. aureus N315; identical to SEQ ID NO: 4250909

SEQ ID NO: 4252054 - RNA, 87 nt, Staphylococcus aureus subsp. aureus N315; identical to SEQ ID NO: 4251545

SEQ ID NO: 4252055 - RNA, 70 nt, Staphylococcus aureus subsp. aureus N315; identical to SEQ ID NO: 4251198

SEQ ID NO: 4252056 - RNA, 57 nt, Staphylococcus aureus subsp. aureus N315
uugcuuaaagaccaacaguuuaaggugaagguaucuggcuguucggauuuagugcaa

SEQ ID NO: 4252057 - RNA, 113 nt, Staphylococcus aureus subsp. aureus N315; identical to SEQ ID NO: 4251032

SEQ ID NO: 4252058 - RNA, 80 nt, Staphylococcus aureus subsp. aureus N315; identical to SEQ ID NO: 4250803

SEQ ID NO: 4252059 - RNA, 127 nt, Staphylococcus aureus subsp. aureus N315; identical to SEQ ID NO: 4250693

SEQ ID NO: 4252060 - RNA, 82 nt, Staphylococcus aureus subsp. aureus N315; identical to SEQ ID NO: 4250912

SEQ ID NO: 4252061 - RNA, 94 nt, Staphylococcus aureus subsp. aureus N315; identical to SEQ ID NO: 4250883

SEQ ID NO: 4252062 - RNA, 63 nt, Staphylococcus aureus subsp. aureus N315; identical to SEQ ID NO: 4250773

SEQ ID NO: 4252063 - RNA, 76 nt, Staphylococcus aureus subsp. aureus N315; identical to SEQ ID NO: 4250885

SEQ ID NO: 4252064 - RNA, 101 nt, Staphylococcus aureus subsp. aureus N315
gcaacgcugauuuaguauuugaagaugcgauugauaaagauggaaaugcacacccguuaacacaagguacauuuauuaaguauuuagaaucagaugaucgc

SEQ ID NO: 4252065 - RNA, 108 nt, Staphylococcus aureus subsp. aureus N315; identical to SEQ ID NO: 4251039

SEQ ID NO: 4252066 - RNA, 63 nt, Staphylococcus aureus subsp. aureus N315; identical to SEQ ID NO: 4251037

SEQ ID NO: 4252067 - RNA, 67 nt, Staphylococcus aureus subsp. aureus N315
uugauuggagcugcauuuaauugaucuuggugauuaugcgcuaagucaacuaagugugcuugaucaa

SEQ ID NO: 4252068 - RNA, 72 nt, Staphylococcus aureus subsp. aureus N315; identical to SEQ ID NO: 4251347

SEQ ID NO: 4252069 - RNA, 88 nt, Staphylococcus aureus subsp. aureus N315; identical to SEQ ID NO: 4250761

SEQ ID NO: 4252070 - RNA, 78 nt, Staphylococcus aureus subsp. aureus N315
gaugaaacguaugaaugcaccguuuuuacuuaucggcgauccucguguugaaggugguagcuuuuauaucgguucauc

SEQ ID NO: 4252071 - RNA, 85 nt, Staphylococcus aureus subsp. aureus N315
gucuuuaccgauaaauacgguguucguuggauguuacauggucaagacuauacugcaauccaacaauaauguuauugauaaagau

SEQ ID NO: 4252072 - RNA, 80 nt, Staphylococcus aureus subsp. aureus N315; identical to SEQ ID NO: 4251047

SEQ ID NO: 4252073 - RNA, 62 nt, Staphylococcus aureus subsp. aureus N315; identical to SEQ ID NO: 4251188

SEQ ID NO: 4252074 - RNA, 85 nt, Staphylococcus aureus subsp. aureus N315
uuuagaacaaaaaagagcaagguuaacgagucagaaaaucuuuuucuugauacguauaugacacuugcucuuuuaagaaucugaa

SEQ ID NO: 4252075 - RNA, 77 nt, Staphylococcus aureus subsp. aureus N315; identical to SEQ ID NO: 4251057

SEQ ID NO: 4252076 - RNA, 113 nt, Staphylococcus aureus subsp. aureus N315; identical to SEQ ID NO: 4251233

SEQ ID NO: 4252077 - RNA, 57 nt, Staphylococcus aureus subsp. aureus N315; identical to SEQ ID NO: 4250807

SEQ ID NO: 4252078 - RNA, 73 nt, Staphylococcus aureus subsp. aureus N315; identical to SEQ ID NO: 4250792

SEQ ID NO: 4252079 - RNA, 87 nt, Staphylococcus aureus subsp. aureus N315; identical to SEQ ID NO: 4251324

SEQ ID NO: 4252080 - RNA, 83 nt, Staphylococcus aureus subsp. aureus N315; identical to SEQ ID NO: 4251611

SEQ ID NO: 4252081 - RNA, 71 nt, Staphylococcus aureus subsp. aureus N315; identical to SEQ ID NO: 4251376

SEQ ID NO: 4252082 - RNA, 78 nt, Staphylococcus aureus subsp. aureus N315; identical to SEQ ID NO: 4251242

SEQ ID NO: 4252083 - RNA, 63 nt, Staphylococcus aureus subsp. aureus N315; identical to SEQ ID NO: 4250947

SEQ ID NO: 4252084 - RNA, 82 nt, Staphylococcus aureus subsp. aureus N315; identical to SEQ ID NO: 4250670

SEQ ID NO: 4252085 - RNA, 57 nt, Staphylococcus aureus subsp. aureus N315; identical to SEQ ID NO: 4250930

SEQ ID NO: 4252086 - RNA, 80 nt, Staphylococcus aureus subsp. aureus N315
gcaagguuaugucuaucaaucguuuuguuaucaaauauuaaaagaagauauuggaaauuaacgauugaugauagguuugu

SEQ ID NO: 4252087 - RNA, 76 nt, Staphylococcus aureus subsp. aureus N315; identical to SEQ ID NO: 4251536

SEQ ID NO: 4252088 - RNA, 104 nt, Staphylococcus aureus subsp. aureus N315; identical to SEQ ID NO: 4251399

SEQ ID NO: 4252089 - RNA, 106 nt, Staphylococcus aureus subsp. aureus N315; identical to SEQ ID NO: 4251139

SEQ ID NO: 4252090 - RNA, 80 nt, Staphylococcus aureus subsp. aureus N315; identical to SEQ ID NO: 4250992

SEQ ID NO: 4252091 - RNA, 77 nt, Staphylococcus aureus subsp. aureus N315; identical to SEQ ID NO: 4250720

SEQ ID NO: 4252092 - RNA, 87 nt, Staphylococcus aureus subsp. aureus N315; identical to SEQ ID NO: 4250990

SEQ ID NO: 4252093 - RNA, 77 nt, Staphylococcus aureus subsp. aureus N315; identical to SEQ ID NO: 4251243

SEQ ID NO: 4252094 - RNA, 68 nt, Staphylococcus aureus subsp. aureus N315; identical to SEQ ID NO: 4250712

SEQ ID NO: 4252095 - RNA, 87 nt, Staphylococcus aureus subsp. aureus N315; identical to SEQ ID NO: 4251004

SEQ ID NO: 4252096 - RNA, 55 nt, Staphylococcus aureus subsp. aureus N315
gauuacaugacacgauagguaauguuugguugcuauguauuguguuauguguguc

SEQ ID NO: 4252097 - RNA, 71 nt, Staphylococcus aureus subsp. aureus N315; identical to SEQ ID NO: 4251293

SEQ ID NO: 4252098 - RNA, 61 nt, Staphylococcus aureus subsp. aureus N315
uguaugaaaaggacaaccuugcggcggauuacuuggcgaagguaauucuccuuuuaauaua

SEQ ID NO: 4252099 - RNA, 65 nt, Staphylococcus aureus subsp. aureus N315; identical to SEQ ID NO: 4251056

SEQ ID NO: 4252100 - RNA, 56 nt, Staphylococcus aureus subsp. aureus N315; identical to SEQ ID NO: 4251006

SEQ ID NO: 4252101 - RNA, 65 nt, Staphylococcus aureus subsp. aureus N315
gucaagaucaagcuguagaaaugguuucacgugcaauucgccguaaucgcgcuggguuugaugac

SEQ ID NO: 4252102 - RNA, 67 nt, Staphylococcus aureus subsp. aureus N315; identical to SEQ ID NO: 4251301

SEQ ID NO: 4252103 - RNA, 70 nt, Staphylococcus aureus subsp. aureus N315; identical to SEQ ID NO: 4251406

SEQ ID NO: 4252104 - RNA, 65 nt, Staphylococcus aureus subsp. aureus N315; identical to SEQ ID NO: 4251003

SEQ ID NO: 4252105 - RNA, 118 nt, Staphylococcus aureus subsp. aureus N315
gcucauuaauuccauuugguuuacaucauauuuucuauucaccguucugguuugaauucggaaguuauacaaaucacgcaggugaauuaguucguggugaccaacguauuuggauggc

SEQ ID NO: 4252106 - RNA, 70 nt, Staphylococcus aureus subsp. aureus N315; identical to SEQ ID NO: 4250703

SEQ ID NO: 4252107 - RNA, 79 nt, Staphylococcus aureus subsp. aureus N315; identical to SEQ ID NO: 4251091

SEQ ID NO: 4252108 - RNA, 57 nt, Staphylococcus aureus subsp. aureus N315; identical to SEQ ID NO: 4251300

SEQ ID NO: 4252109 - RNA, 73 nt, Staphylococcus aureus subsp. aureus N315; identical to SEQ ID NO: 4250665

SEQ ID NO: 4252110 - RNA, 79 nt, Staphylococcus aureus subsp. aureus N315; identical to SEQ ID NO: 4250964

SEQ ID NO: 4252111 - RNA, 57 nt, Staphylococcus aureus subsp. aureus N315; identical to SEQ ID NO: 4251165

SEQ ID NO: 4252112 - RNA, 96 nt, Staphylococcus aureus subsp. aureus N315; identical to SEQ ID NO: 4251341

SEQ ID NO: 4252113 - RNA, 78 nt, Staphylococcus aureus subsp. aureus N315
gauagcugcauagggagugggacagaaaugauauuuucgcaaaauauauuucgucgucccaccccaacuugcauuguc

SEQ ID NO: 4252114 - RNA, 62 nt, Streptococcus pneumoniae R6
ggaaagguggcuauuucaaagacaaauacgcaagguaagaaauugagaauagccuaucuucc

SEQ ID NO: 4252115 - RNA, 73 nt, Streptococcus pneumoniae R6
ucuauuuuacuuuauaucacaauugauuggucaacuauugauaagucaauggauaggaggaagaaaugauaga

SEQ ID NO: 4252116 - RNA, 84 nt, Streptococcus pneumoniae R6
ggaaaaauaggagcaucuuuauuggaagaagcuugauuucccgcaaucauagauucuucuucaauauagauagacauauuuucc

SEQ ID NO: 4252117 - RNA, 82 nt, Streptococcus pneumoniae R6
ucaccaaucagaacgauagaacucugagucucacugauaagaaacugucugaaacuccguuucucucuucuggaauuggugg

SEQ ID NO: 4252118 - RNA, 70 nt, Streptococcus pneumoniae R6
ccugaggauuaguuggcuugucuuuguagcucgaagcaauagcaacugcaacagccaagucaaucgcagg

SEQ ID NO: 4252119 - RNA, 90 nt, Streptococcus pneumoniae R6
gccaaaaucagccgcaauuuguucauaagugcgcuauucucgcauguauugaauaguuaccaugaggagaucgucuaggcuuaauuuggu

SEQ ID NO: 4252120 - RNA, 105 nt, Streptococcus pneumoniae R6
ggcccuugggguggugaugguggucguggaggcaauguggucuucguuguagacgaaggacuacguaccuugauggauuuccgcuacaaucgucauuucaaggcu

SEQ ID NO: 4252121 - RNA, 55 nt, Streptococcus pneumoniae R6
aaguugaagagcuuguagaaacagcacuuucuguuggaaucaaugccuucgacuu

SEQ ID NO: 4252122 - RNA, 103 nt, Streptococcus pneumoniae R6
uggcuuuuguaguauaauugucuugcaucucugugccuuucuuguguuugugguugaacaacaaguauaacacagagguguuuucuuaugccuacaagagcua

SEQ ID NO: 4252123 - RNA, 68 nt, Streptococcus pneumoniae R6
aauugagagaaugguaugucaagauguuggaggaagcucaaagucuaaacauuccaguuuucuugguu

SEQ ID NO: 4252124 - RNA, 66 nt, Streptococcus pneumoniae R6
gggcauucaguauuacuugaauagaggaaaacaucaucucccuuauguucucaauauuggauuucc

SEQ ID NO: 4252125 - RNA, 83 nt, Streptococcus pneumoniae R6
uuggauaaggcuuugucagauuugucagaauuaucacguagucucgcgaaugaacaaauuaaaucaggccaggucuuggucaa

SEQ ID NO: 4252126 - RNA, 70 nt, Streptococcus pneumoniae R6
ugagcaauucuaagcuuagaauugccauaaaauaaauguuuucaggcuauucuaagucuuugacugcuua

SEQ ID NO: 4252127 - RNA, 57 nt, Streptococcus pneumoniae R6
gagauaucagucagauugaccugccacguaaugucaaguccgguuugauugaugcuc

SEQ ID NO: 4252128 - RNA, 72 nt, Streptococcus pneumoniae R6
ucuagauugauauuuuugagaaccugcaauucuuggucaccauuacgguagcuucugaagauauuuuuuaga

SEQ ID NO: 4252129 - RNA, 63 nt, Streptococcus pneumoniae R6
gagauuagagugaaucuugugcgcuucuacuaaggagucuuccgcuucuucaacuuuaauuuu

SEQ ID NO: 4252130 - RNA, 66 nt, Streptococcus pneumoniae R6
cuguuacuaagugagauacugcuguaaucauaccacggauagcagcguuaucuucuuuaauaacag

SEQ ID NO: 4252131 - RNA, 58 nt, Streptococcus pneumoniae R6
uucagcuaucuaaggacuuggauuugccuuuuguuguccauacccgugaugcgcugga

SEQ ID NO: 4252132 - RNA, 77 nt, Streptococcus pneumoniae R6
cgucgcagcauuguccagauagaccagagguucaucauugacaaucugaucuaaaauuggaaaauccuugcgaaucg

SEQ ID NO: 4252133 - RNA, 104 nt, Streptococcus pneumoniae R6
gcugguguggcgacucacuuuguggagaaacuuucagacacggaacaacucaauaaaaagguuaagauuauuccuuuggaagucgugcuccgcaacuauacugc

SEQ ID NO: 4252134 - RNA, 55 nt, Streptococcus pneumoniae R6
uuguuccuugagauacaagugcauaucugucgcaacuuggucauuucgagaacga

SEQ ID NO: 4252135 - RNA, 57 nt, Streptococcus pneumoniae R6
augaacugcaccccaaaaguuagacagaauaaaucuaacuuuuggggugcaguucau

SEQ ID NO: 4252136 - RNA, 69 nt, Streptococcus pneumoniae R6
agaccguuugcuacuggguagucaaaguuaucagaugggaugaaaacuuuaccaauagcaaaugguacu

SEQ ID NO: 4252137 - RNA, 75 nt, Streptococcus pneumoniae R6
cacgagacgaugcaguuggggaggcuuaugacaaggucggucgugucaugggcuugaccuauccugcaggucgug

SEQ ID NO: 4252138 - RNA, 130 nt, Streptococcus pneumoniae R6
caucaagcauaacgcgguugauaagacgaguaacuaguugugaauuguauagcggaucuggcaauacgucacguuuuggagcucuauuuuuacgacucauuucucuuuauccccuuuccuuaugcuuuug

SEQ ID NO: 4252139 - RNA, 72 nt, Streptococcus pneumoniae R6
ggucuaucaagagucgauugaccuugaguugcuggucaaugcacuuaaucaucacuugcucauugacagacu

SEQ ID NO: 4252140 - RNA, 130 nt, Streptococcus pneumoniae R6
gcuaugagcuaagaaacccucguguugauacggucgaauuggcccaggucuuuuucccugaacuggaaaaauauagcuugccgauuuugugucgagaauuaggaauuccucuuaaacacgcacacacagc

SEQ ID NO: 4252141 - RNA, 130 nt, Streptococcus pneumoniae R6
aauccaguuugagcuuguuuaauuucuauuuucuuaccaucuugguaggcagaccaaccuuugucauaaggaauggugaagaaaauagauguaucuuguuggacaucauauguagcaaaaaccuuguuuu

SEQ ID NO: 4252142 - RNA, 81 nt, Streptococcus pneumoniae R6
uuuuggauaaaaaaaugguucuauaauauuuguaguggguaaauccccuauggauauuauggagccuauuuuuguguagaa

SEQ ID NO: 4252143 - RNA, 112 nt, Streptococcus pneumoniae R6
cuugguucauuccaucaaaggucuggaaaaugcagagaugaugcgaacagguuaugcuauugaguaugauauggucuugccucaucaguugcgugcgacuuuggaaaccaag

SEQ ID NO: 4252144 - RNA, 69 nt, Streptococcus pneumoniae R6
ggcaggagaacucaagcacggaaccauugccuugauugaagaaggaacaccugucuuggcucucuuguc

SEQ ID NO: 4252145 - RNA, 88 nt, Streptococcus pneumoniae R6
aaacaugggcucauaucaaaaagcaccucaaaaagguauuaccaaguugcaauaccuuuuaugaggcucuuuuguccugcucuuguuu

SEQ ID NO: 4252146 - RNA, 61 nt, Streptococcus pneumoniae R6
gauugucuagauugucuucaggcugaucaauaaucaauggucugaagucuuuagaauaauc

SEQ ID NO: 4252147 - RNA, 61 nt, Streptococcus pneumoniae R6
gugagccauggucgcuucugugaggagcuuagagguagcacagaaaugauuaugggcccac

SEQ ID NO: 4252148 - RNA, 58 nt, Streptococcus pneumoniae R6
auuuugcuacuaaauugacuaacgaauauaagaaaauuagucaguucagaagcaaggu

SEQ ID NO: 4252149 - RNA, 76 nt, Streptococcus pneumoniae R6
gcggaaucuuuggauuuugguuuguuuuucaaaauuggcaacagagucaagcgagucaaaaucuggcggauucugu

SEQ ID NO: 4252150 - RNA, 73 nt, Streptococcus pneumoniae R6
augguuuugguuucucacuuuggaguucgauaauauccaucuuauccaauuucuuuugacgagacauagccau

SEQ ID NO: 4252151 - RNA, 55 nt, Streptococcus pneumoniae R6
aguuugaugacugguaauggugcuccgagaacaccgagaauaugggugucaaacu

SEQ ID NO: 4252152 - RNA, 73 nt, Streptococcus pneumoniae R6
uuuuucuugcuaguuuuaggauuuucuuguaaaauagaaaaagugaagagagguaugaaaugagcaagaaaga

SEQ ID NO: 4252153 - RNA, 60 nt, Streptococcus pneumoniae R6
gucugcauggcauaaugauaucuauagugaguuuuaucuuggucaucaugccaucgcagc

SEQ ID NO: 4252154 - RNA, 76 nt, Streptococcus pneumoniae R6
aagugcuuuguaaaggucuuuaccuucuuuuuuguacaauucugucaagucagcguaagcaccuuuuugagcauuu

SEQ ID NO: 4252155 - RNA, 98 nt, Streptococcus pneumoniae R6
cucguaccauugaauuuacagaugaggaacaaaagguugucaaaggucuuuuccuuuugacgacuaaaccaguucuuuauguagcuaauguggacgag

SEQ ID NO: 4252156 - RNA, 76 nt, Streptococcus pneumoniae R6
uguagcccucaauccagauuuugcuccauuugaauaucaaaaagugguugaugggaaaaaucagauuguggguuca

SEQ ID NO: 4252157 - RNA, 113 nt, Streptococcus pneumoniae R6
cgaagucgguggugucccugcgguuaugaaguacuuguuggcaaaugguuuccuucacggagaucgcaucacauguacugguaagacuguagcugaaaacuuggcugacuuug

SEQ ID NO: 4252158 - RNA, 88 nt, Streptococcus pneumoniae R6
gaguuauucuaugaaacaggaacugggacuguuuccuuuaaggauauugagcugguagagguagcagaccagccuucugaggauucuc

SEQ ID NO: 4252159 - RNA, 100 nt, Streptococcus pneumoniae R6
gauuggcugauaaagaugaagagugguuucuugcugagaaguggcauaccguagccccacucagaugagaugccaaguucaacugguguaucugucaauu

SEQ ID NO: 4252160 - RNA, 105 nt, Streptococcus pneumoniae R6
aucuucccagugcucaagcgcauguuggaacguauucucggaaaaucaccauacgcuucaccgacagauaugggugucaacaugguugguuucgcuauuacagau

SEQ ID NO: 4252161 - RNA, 64 nt, Streptococcus pneumoniae R6
uagaauuuuugcucuauuucuggggaaaucagacguuuuucuaguaaguacuguaaaaguuuug

SEQ ID NO: 4252162 - RNA, 84 nt, Streptococcus pneumoniae R6
accguuuagguggagaucuuuagucacaggaagguuaauaguaaucugauuggcuuucccuugauagagcucuguauugaaggu

SEQ ID NO: 4252163 - RNA, 118 nt, Streptococcus pneumoniae R6
ucauccuugucaccugucucauaggcuucuuccaagcgguaauaaucugccaguggaaacuuagagucaauuggcagauagacguauucuuggucgccuuguccggguaacuugaugg

SEQ ID NO: 4252164 - RNA, 80 nt, Streptococcus pneumoniae R6
aguaggcuggaugaauguugacaauccgaccuucauaagccgacaauaagguugguccaacgauuuucauguagccugcu

SEQ ID NO: 4252165 - RNA, 63 nt, Streptococcus pneumoniae R6
gacacgaucuucaugaagccaccuucacgcaauucacgugcaacugggccaaagauacguguu

SEQ ID NO: 4252166 - RNA, 71 nt, Streptococcus pneumoniae R6
gagaagauuggauagaacuucgugggccgcuucuuugggaguucccaaacuagcgaugaguucuucuucuc

SEQ ID NO: 4252167 - RNA, 96 nt, Streptococcus pneumoniae R6
gcuaaaaaaaauaucccaaucuuaugaacugcaccccaaaaguuagauuuauucugucuaacuuuuggggugcaguucauuuugcauaguuuuggc

SEQ ID NO: 4252168 - RNA, 61 nt, Streptococcus pneumoniae R6
gugggcccauaaucauuucugugcuaccucuaagcuccucacagaagcgaccauggcucac

SEQ ID NO: 4252169 - RNA, 71 nt, Streptococcus pneumoniae R6
cuucaucgauugcaacaucgguaauaguuaccuuguuuccuaggugauuagugauguuggaguguuugagg

SEQ ID NO: 4252170 - RNA, 84 nt, Streptococcus pneumoniae R6
gcguggcuuuaucuuauaucaguuuaaucaagccauaucuuucagagagugugcgugaacaaauugauuuauuagaaguuaagc

SEQ ID NO: 4252171 - RNA, 91 nt, Streptococcus pneumoniae R6
uaguaaaacuugcccaguauccgucuauagaaacggagcguuuauugcuuagaccuguaacuuuggaugaugcggaagcaauguuugacua

SEQ ID NO: 4252172 - RNA, 70 nt, Streptococcus pneumoniae R6
gagucugaaggugauaugaauaaguucugggaaaucuucaacgagcgaaugaauaucgcagaagaugcuc

SEQ ID NO: 4252173 - RNA, 85 nt, Streptococcus pneumoniae R6
gauuuggucauuaaaacucuugauagauuccaauucuucuucugucaaaggagguguugucuuucgauguaaagauugccaaguc

SEQ ID NO: 4252174 - RNA, 108 nt, Streptococcus pneumoniae R6
auuauugaucuugcgaaugacaguugaaguugaaauagacaacugaugaucaaugucggucauagaagucuuuucaauuagcuucugagcaaucuuuugguugaugau

SEQ ID NO: 4252175 - RNA, 78 nt, Streptococcus pneumoniae R6
ugccuucaaugauauuuccguuguagcuaagcgguuuuguagaagugacauaaccaucugcacgacggaagucaggcg

SEQ ID NO: 4252176 - RNA, 70 nt, Streptococcus pneumoniae R6
ugucuauaaaauggguugggcuggucaggcaggcuggggaacggcuaucuacuuaacucuuuauaugaca

SEQ ID NO: 4252177 - RNA, 74 nt, Streptococcus pneumoniae R6
ugccacggauucgugcgauuuuagaagggauggagcaaccuacucuagccuaucucaucgcacaacuggaugca

SEQ ID NO: 4252178 - RNA, 67 nt, Streptococcus pneumoniae R6
uccaaauguaacucguacuucaggagccuuccucaugguucgugguacggaacguuaccuauuugga

SEQ ID NO: 4252179 - RNA, 66 nt, Streptococcus pneumoniae R6
gacuauugacucagcccuuacuucaugcggaugaaacuucuuauagggugcuagagagugauaguc

SEQ ID NO: 4252180 - RNA, 58 nt, Streptococcus pneumoniae R6
uugacaucaauggugugcgcgugguugucgaugccaaaguuguggacaaggaugucaa

SEQ ID NO: 4252181 - RNA, 81 nt, Streptococcus pneumoniae R6
cgucuacuuaugccaagcuuggugagaagcguuaugcuguucauauggaugcuucuuccgguguuuuguauuuuguagaug

SEQ ID NO: 4252182 - RNA, 71 nt, Streptococcus pneumoniae R6
ugcuuaagauucguuaucauaaacaguuuaaaaaagauuuuaaguuggcuaugaagcgugguuugaaggca

SEQ ID NO: 4252183 - RNA, 66 nt, Streptococcus pneumoniae R6
gcugaccaagcauacgacuucaugcgugaugcagcagcuaacgaugcaguuguauuguucguuggu

SEQ ID NO: 4252184 - RNA, 61 nt, Streptococcus pneumoniae R6
uucaagaagacuuuguuaaagaagucaucuguaaaucgacuugcuucuaagucuucuggag

SEQ ID NO: 4252185 - RNA, 58 nt, Streptococcus pneumoniae R6
ugaauaacuucacacgcgauuugacuaugaacguacaggaucugcaggaaguuguuca

SEQ ID NO: 4252186 - RNA, 59 nt, Streptococcus pneumoniae R6
ggguagcuauacaggcuugcgaauugcgguagcaacugcuaagaccuuagcucacaccc

SEQ ID NO: 4252187 - RNA, 56 nt, Streptococcus pneumoniae R6
ggucaaggucaagaaaaacuggcgcgauaaaaagcuagauuuggcugacuuuggcu

SEQ ID NO: 4252188 - RNA, 130 nt, Streptococcus pneumoniae R6
acggcgaauuugcugcggguauucaucagucaggaucuaugaucuuuggugaacaagaaaagguucaaguugugaccuuuaugccaaaugaagguccugaugaucuauacgcuaaguuuaauaacgcugu

SEQ ID NO: 4252189 - RNA, 65 nt, Streptococcus pneumoniae R6
ugugacaaggauaugcugacuuuguuuagucugaugcgagcaaacccuuggcaaauccuguggca

SEQ ID NO: 4252190 - RNA, 83 nt, Streptococcus pneumoniae R6
gugaaaaaagcugauaaugaugcuaaaaacggagauuauucaaagaucgguuuuuaucauuauucaaguuugguuuuaaucac

SEQ ID NO: 4252191 - RNA, 78 nt, Streptococcus pneumoniae R6
aaaucuuuaaaaucagaaaaacguaucauaucaggugaugaaaauuuugauacuaugcguuuuauguugguaagauuu

SEQ ID NO: 4252192 - RNA, 115 nt, Streptococcus pneumoniae R6
ucaauuugagggaaagauccaguacuuuuucuaugauaaaaggcauccuaucaagguuuuugaacaccugauaggaugccuuuuuaugauauugaggccuuuuugcccuuuuuga

SEQ ID NO: 4252193 - RNA, 74 nt, Streptococcus pneumoniae R6
gaaaacgacugaaaauuaggaaccugacgagaaauccugauuuuucagucagauuaucuauuuuccgaguuuuc

SEQ ID NO: 4252194 - RNA, 78 nt, Streptococcus pneumoniae R6
auagaaaugauggucaaagcucauggauguugcaggcuuuuuuguccugcacuucuuuguaguuuugacuguuuuugu

SEQ ID NO: 4252195 - RNA, 72 nt, Streptococcus pneumoniae R6
ggaugaaacaguaugagagggauagaggacuauuccuaaguuuacuacuaucucuuuuauaugagagcacuc

SEQ ID NO: 4252196 - RNA, 84 nt, Streptococcus pneumoniae R6
cacuuguuagaauuaaaaaugagguauucaggcuugugauuuccuauggaaguuaauaguaauugccucuagugcuuacaagug

SEQ ID NO: 4252197 - RNA, 70 nt, Streptococcus pneumoniae R6
ugccccaacuuggugggcuaauugagugauuuccuugaucggauugaccacaccaagaacauuggaggca

SEQ ID NO: 4252198 - RNA, 92 nt, Streptococcus pneumoniae R6
cgcugaggcgguaucacugcuuguacgaguugaagcaucagcgaaguaaaaguagauguucagccaaugcgacgaggugagaccgaaggucg

SEQ ID NO: 4252199 - RNA, 80 nt, Streptococcus pneumoniae R6
acuaggaaagauguacggcuuauuccgugagcguuuaggacguaguacaacgaaucaugggagucagcugaacacauagu

SEQ ID NO: 4252200 - RNA, 78 nt, Streptococcus pneumoniae R6
uuucuugaaucgucugccaaaagaucauguguccuauugggauuugauuuuuaaugaugguagugaucaaucacgaga

SEQ ID NO: 4252201 - RNA, 55 nt, Streptococcus pneumoniae R6
ucuuugauauguugaugggggaucgaguagagccucgucgugaguuuaucgaaga

SEQ ID NO: 4252202 - RNA, 89 nt, Streptococcus pneumoniae R6
cuaucugcaaccucaaaacaguguuuugagcugacuucgucagucuuaucuacuaccucaaaacgguguuuugagcaaccuguagcuag

SEQ ID NO: 4252203 - RNA, 74 nt, Streptococcus pneumoniae R6
uucuagcucuuucugguggauuagauuccauguuucuauuuaagguauugucuacuuaucaaaaagaguuagag

SEQ ID NO: 4252204 - RNA, 77 nt, Streptococcus pneumoniae R6
ccaaguaauacggugcuggaugaacucuggaaugauuucaaacugacaccagaaguugaaauccgcaaccgucuugg

SEQ ID NO: 4252205 - RNA, 61 nt, Streptococcus pneumoniae R6
uuccaaguaucaauagagaugaggacaucacuuuccuugcgaaucgcuuugaucacuggaa

SEQ ID NO: 4252206 - RNA, 60 nt, Streptococcus pneumoniae R6
gacgacugcugcuaagaaacaugguuuggagaacaagauuguuaucuugacagcgacauc

SEQ ID NO: 4252207 - RNA, 60 nt, Streptococcus pneumoniae R6
aggaacuguugaaagcaguggauggauuaagguuuguaccauccuugcccaauaguaacu

SEQ ID NO: 4252208 - RNA, 57 nt, Streptococcus pneumoniae R6
augauaaaaacgcauaauaguggguguagaaacucuuguuacuaugcguuuuguuau

SEQ ID NO: 4252209 - RNA, 108 nt, Streptococcus pneumoniae R6
gaagaccagcuuaauuauaccuauagaguagcagaagcaucucauucuauuuuuaauguugcuuugauugugcuaucuacuauuuuaguggucguagcgauugucuuc

SEQ ID NO: 4252210 - RNA, 61 nt, Streptococcus pneumoniae R6
auauuuuuuaucaagguaaaaagaaagggcuaucuagguuagauaucuugauagaaaauau

SEQ ID NO: 4252211 - RNA, 96 nt, Streptococcus pneumoniae R6
gguuggcguggugcugauaugcagaauaucuuggacuuugaaaaggauuaccccaaagccaagguuguuuugcuggaggaaaauuaccgcucaacc

SEQ ID NO: 4252212 - RNA, 70 nt, Streptococcus pneumoniae R6
ggcaguuugaucauagaugucagcauugguauccauacucaauaaggacuugaugacuccauaagcugcc

SEQ ID NO: 4252213 - RNA, 85 nt, Streptococcus pneumoniae R6
gucguuuucuggucgauggaaauagcugggcugagaccaucaauggcaucuacaucugguuuuuccauauuucccaagaacugac

SEQ ID NO: 4252214 - RNA, 65 nt, Streptococcus pneumoniae R6
caaucucaauaaucuccagcaagaguuccuuaggauaaagggcuccaguuggguuauuuggauug

SEQ ID NO: 4252215 - RNA, 94 nt, Streptococcus pneumoniae R6
ugacauuuuaauuuugaaacaaagauaagguucgauugaauagauuuauguucguauucuuuagguaccuaucuuaugauuucaggaaauguca

SEQ ID NO: 4252216 - RNA, 55 nt, Streptococcus pneumoniae R6
aaugucaguggaagaggugcuuuauagugcuauggaggacuucuacauagauauu

SEQ ID NO: 4252217 - RNA, 64 nt, Streptococcus pneumoniae R6
caaguauuuugaaggagugucacggauuccgagaacgguucuagaugcccaucgagagggcuug

SEQ ID NO: 4252218 - RNA, 79 nt, Streptococcus pneumoniae R6
ggauuuaucucuaucucagcucgaagucguaguaaacugaauguacaacggauuauggaagaguuaggcgguggaggcc

SEQ ID NO: 4252219 - RNA, 76 nt, Streptococcus pneumoniae R6
acagcuuuggcaaaaaagaccaauuugcuuuggagcauugcuucugcauucaauugucuauuuuugcucgugcugu

SEQ ID NO: 4252220 - RNA, 63 nt, Streptococcus pneumoniae R6
cuugaccagauaaaauaccaaaugcaguaccaauaaucgcaccugaaauaguaucugguggag

SEQ ID NO: 4252221 - RNA, 59 nt, Streptococcus pneumoniae R6
gcuggucucgguucuggcuuuacugaugcugacuaucaaaagcaaggagcugagauugu

SEQ ID NO: 4252222 - RNA, 72 nt, Streptococcus pneumoniae R6
ggacuuuuuuaccuguaccuaauuuuuuggcaaccucgauggcuccguagauagcugcagcugaggaaaucc

SEQ ID NO: 4252223 - RNA, 85 nt, Streptococcus pneumoniae R6
aauuuuguggugaugagucugaauuaaguauccgucaauuaauuagaauugaaaauggagaauccagaccaacacuaacaaaguu

SEQ ID NO: 4252224 - RNA, 81 nt, Streptococcus pneumoniae R6
ucgauauugucaaucuugguuugaucuaugagauucguuuugacggugacacagggcaaacagagauugacaugacuuuga

SEQ ID NO: 4252225 - RNA, 58 nt, Streptococcus pneumoniae R6
guaugauaaggagagaugagaaugaauugacuuucugaauuucucagucuuaucauau

SEQ ID NO: 4252226 - RNA, 58 nt, Streptococcus pneumoniae R6
uaugagcggaaggauuugaugccagaaggugagcgucggguugaguuucaugcucaua

SEQ ID NO: 4252227 - RNA, 57 nt, Streptococcus pneumoniae R6
gucaaaacuacaaagaagugcaggacaaaaaagccugcaacauccaugagcuuugac

SEQ ID NO: 4252228 - RNA, 57 nt, Streptococcus pneumoniae R6
uuggggagucaauggaagguuauacaccaggugaacugccuucuauugauuucuuag

SEQ ID NO: 4252229 - RNA, 63 nt, Streptococcus pneumoniae R6
guuugccagcaggugacugguagguaacaucuugcauuguuccugcaguugcuugcggugcac

SEQ ID NO: 4252230 - RNA, 83 nt, Streptococcus pneumoniae R6
uucagguaaaggaguggaugaaggcaauaucuggggugacuacuauuaccuagaagcccuuauccguuucuacaaagacugga

SEQ ID NO: 4252231 - RNA, 66 nt, Streptococcus pneumoniae R6
cuaaguuaucuuaucguuagcugucaaaacugguagguuuugauaggcuggcgauaugauuuuugg

SEQ ID NO: 4252232 - RNA, 65 nt, Streptococcus pneumoniae R6
agguauucucuuugccaacugguacaguaaugggaaugaaaucccaguugacaaagaugaggccu

SEQ ID NO: 4252233 - RNA, 59 nt, Streptococcus pneumoniae R6
gguuuuccaccauuuguagccaugauagaaauacaacuagcugcauccuguggagaacc

SEQ ID NO: 4252234 - RNA, 55 nt, Streptococcus pneumoniae R6
cuucuagaaugucuuccaaacgagaaaacucucguaaacaaagagguuuuagagg

SEQ ID NO: 4252235 - RNA, 66 nt, Streptococcus pneumoniae R6
cgaagcggguuuaagaacauucgagauguguugaaucucaacuuuggaaaucuggaagcucgcucg

SEQ ID NO: 4252236 - RNA, 126 nt, Streptococcus pneumoniae R6
uugucauggcggauacucccuucuaugaugccauugauggugucuguauagaguguccauucaucuuuuagggucaagagcugcucuauaccaccguuugucaaggaguaguauuugcgcaugcga

SEQ ID NO: 4252237 - RNA, 79 nt, Streptococcus pneumoniae R6
gccuagggcuauugacaaaagugaaagaaucagauagaauaguaaaguauguuuaguaacugaucacuuuauagccggc

SEQ ID NO: 4252238 - RNA, 66 nt, Streptococcus pneumoniae R6
cgugauuuucucaaagcugaugccaagauuuuuugggcacagcuaggacuugaaaguuuagaagcg

SEQ ID NO: 4252239 - RNA, 91 nt, Streptococcus pneumoniae R6
gaaccaugaaguguuguaaaugcuguauuguagcuaguucuuaacguuuagagaacuggcuagcuuuacgagcuuucuuaagaucugguuc

SEQ ID NO: 4252240 - RNA, 65 nt, Streptococcus pneumoniae R6
gauuuugcaaaugaucaugcucaugcauuuuucauggauaauguugaguggagucaugcagauuc

SEQ ID NO: 4252241 - RNA, 68 nt, Streptococcus pneumoniae R6
uauucauggauaugcagguguagaugugauggacaacaacauugaagguacauugcauacuaugagug

SEQ ID NO: 4252242 - RNA, 60 nt, Streptococcus pneumoniae R6
auagacacauuuuuauccaacugaaagacaucaacacuauuauggaaaagaauggucugu

SEQ ID NO: 4252243 - RNA, 78 nt, Streptococcus pneumoniae R6
gguggucaacgucagagaaucgcuuuggcgcgugcucucuugacagaugcgccggucuugauuuuggaugaggcgacu

SEQ ID NO: 4252244 - RNA, 71 nt, Streptococcus pneumoniae R6
augacagagguuguuagaaaaauuugucagcuuucuuuugaggaauuuggcuuaaaacaauuaucuaucau

SEQ ID NO: 4252245 - RNA, 62 nt, Streptococcus pneumoniae R6
aaggaaacagguaucuggaaguuugagacaacaccucgcaugucuucuuacuuguuggccuu

SEQ ID NO: 4252246 - RNA, 83 nt, Streptococcus pneumoniae R6
gcaugcaauccaaguaagagcagaucaugucuuugauggagauuuaucagacuaugauaugauuguucuuccuggagguaugc

SEQ ID NO: 4252247 - RNA, 64 nt, Streptococcus pneumoniae R6
uacugggaagaauucaacguugauagucgcuuuacggauaccagcuuucaauucuucguuagug

SEQ ID NO: 4252248 - RNA, 66 nt, Streptococcus pneumoniae R6
gagaauggaguacaagauuuuguuucuuaucucaacgaagauaaggaaaucuugacgccaguucuu

SEQ ID NO: 4252249 - RNA, 58 nt, Streptococcus pneumoniae R6
cuagucuuggucuagugguggcaacaagugguuuugcuuugcuaggaagaaagacuag

SEQ ID NO: 4252250 - RNA, 58 nt, Streptococcus pneumoniae R6
aaaugagcuucaggcauuaaaccuucauuugcaaaggcagcguaugcuugagccauuu

SEQ ID NO: 4252251 - RNA, 72 nt, Streptococcus pneumoniae R6
ugugauugcuuguagauucaaagaugggacaaagauauaguccaguaauacccaagucuugcaaguaaucca

SEQ ID NO: 4252252 - RNA, 129 nt, Streptococcus pneumoniae R6
uugagaaagauaccaaacccaucaaaaagcgaagggaaaauaggaguugggcgcagugagcgaugcucgcuagaccaacuaucuuuuucccacugcuuuuaggguggggucaauuccuuucuuucuuaa

SEQ ID NO: 4252253 - RNA, 76 nt, Streptococcus pneumoniae R6
ggcuaucaauuggaauguaggcaugaccugacuuagucagcgcuacaaagguugccaacauuucauauucuuggcc

SEQ ID NO: 4252254 - RNA, 91 nt, Streptococcus pneumoniae R6
uccaaaauauugguuaagcgaugcagcuccccccuguccuaaaagauaaggacgguaggaacgauuguauuucucagcuaauaccgcagga

SEQ ID NO: 4252255 - RNA, 56 nt, Streptococcus pneumoniae R6
acgcucaagcucuucuuaaugaauacggacgucuugauucagauucauuugagcgu

SEQ ID NO: 4252256 - RNA, 107 nt, Streptococcus pneumoniae R6
auuauucagcaagaacgagaaauguaccaagaugauccagauucguguuuauucuuuucaacuuuagcgaauuuguauccugguacaccuuuagcaacugauauagu

SEQ ID NO: 4252257 - RNA, 61 nt, Streptococcus pneumoniae R6
gaugcagaugucuuuguuuaccauucucauacacucgaaucuugggcaggaagucuggauc

SEQ ID NO: 4252258 - RNA, 55 nt, Streptococcus pneumoniae R6
aaaacgacuccuuuucucuaacuugaaaaauagauuagagaaaauggguuguuuu

SEQ ID NO: 4252259 - RNA, 55 nt, Streptococcus pneumoniae R6
gcaaaaacgcauaguaucagguauugaaaaaacuugauacuaugcguuuuaaugu

SEQ ID NO: 4252260 - RNA, 82 nt, Streptococcus pneumoniae R6
uuuuaaaaaaugguugacaucgacuccuauaugaguauaauaguuaguauacauuagaaaagagguuaacuauuuugaaaaa

SEQ ID NO: 4252261 - RNA, 127 nt, Streptococcus pneumoniae R6
ccauguuuacuaucgcugcagaguuaaauauuguagcagaauuaccauucuuccuuacuugguuuacaacaggaaucggugaauuugcuucauugauuauuggagcgauuauuauugguaaaauugg

SEQ ID NO: 4252262 - RNA, 64 nt, Streptococcus pneumoniae R6
ucugguaagauaccgucacagugugaacuuuccacucucacacucguucuucucuuacaacaga

SEQ ID NO: 4252263 - RNA, 68 nt, Streptococcus pneumoniae R6
cugcagauucauaaucagcugcgaaguauucagcguuggcauuugcaaaaugacgcaugaguuugaag

SEQ ID NO: 4252264 - RNA, 88 nt, Streptococcus pneumoniae R6
ugggucuugacagacuuugucuucuauauggguggaggucuuauauuugcagucuuauuuagaaugacaaagucaauuuauuggccua

SEQ ID NO: 4252265 - RNA, 55 nt, Streptococcus pneumoniae R6
ugcucgcauguaaccugucucagcgucaaauagcuggcgguaauuuugugaagca

SEQ ID NO: 4252266 - RNA, 78 nt, Streptococcus pneumoniae R6
aagucuuuaaaaucaaaaaaacgcauaauaucaggugugcaaaaacuugauacuaugcguuuuauugugggaagguuu

SEQ ID NO: 4252267 - RNA, 63 nt, Streptococcus pneumoniae R6
ugaccguuuuuacuuugugcaaaaggauggucaaaccuaugcucuugcuaaggaagaagguca

SEQ ID NO: 4252268 - RNA, 67 nt, Streptococcus pneumoniae R6
ggcauucuugucagguguugccaaauucccucaaagaaucaagugugcaacccuaacuuggaaugcc

SEQ ID NO: 4252269 - RNA, 55 nt, Streptococcus pneumoniae R6
augaccugaauuuccuuaggcagagugauuccugucaaggaauucuuagguacau

SEQ ID NO: 4252270 - RNA, 82 nt, Streptococcus pneumoniae R6
ucaaagcacugcuuugagguuguagauaagacugacgaagucagucacauauauaauccaaggcgacguugacgugguuuga

SEQ ID NO: 4252271 - RNA, 55 nt, Streptococcus pneumoniae R6
cuucuagaaugucuuccaaacgaggaaacucucguaaacaaagagguuuuagagg

SEQ ID NO: 4252272 - RNA, 73 nt, Streptococcus pneumoniae R6
guucuaacuaccaagucccaguugaaguucguccagaacgucguacaacacuuggacuucguugguugguaac

SEQ ID NO: 4252273 - RNA, 72 nt, Streptococcus pneumoniae R6
gcagauuuauggacauuucguggcagaauaaucuuaucuccugccuugcagguugccagaaucauagucugc

SEQ ID NO: 4252274 - RNA, 78 nt, Streptococcus pneumoniae R6
ccaucagacaaaauagaacgauuugaaggcguuuaugauauuuagcuguacgagagucuuuuaaaaguguuuugaugg

SEQ ID NO: 4252275 - RNA, 57 nt, Streptococcus pneumoniae R6
aaguuacuggggauauucuaauacagcauacucuauugguauuauaauuaguggcuu

SEQ ID NO: 4252276 - RNA, 56 nt, Streptococcus pneumoniae R6
uguggcgacaaacugaugcgaagggauuccuucaagcguucugaauuugcgccaua

SEQ ID NO: 4252277 - RNA, 108 nt, Streptococcus pneumoniae R6
gguagugaugguguuuauaauuaccuaagugcuuuacgaguggccagcgaugacagggcugcugacaaaggaguuuuggucguuaugaacgaugaaauccacgcugcc

SEQ ID NO: 4252278 - RNA, 92 nt, Streptococcus pneumoniae R6
ugggaaguuagaagguuugaaaauugcaacccuggaagcuauuuacccgcaacaaauccaggcuuuucguucaaaucuugcucaauuugaca

SEQ ID NO: 4252279 - RNA, 80 nt, Streptococcus pneumoniae R6
aagucuuuaaaaaucagaaaagcgcauaguaucagguguugaaaaaacuugauauuguguguuuuauuaugggaagauuu

SEQ ID NO: 4252280 - RNA, 57 nt, Streptococcus pneumoniae R6
uugacaagugauuucuggauugcugaauauuuucuuagcaaccaagucauuggucgg

SEQ ID NO: 4252281 - RNA, 60 nt, Streptococcus pneumoniae R6
uggcggauacgcuugaaguggcuaaugcaacacugggugcccuucguggacguauugcua

SEQ ID NO: 4252282 - RNA, 78 nt, Streptococcus pneumoniae R6
ucacaggcauuucgggaagagaaaaagacugcaccaaacgguccaaucuuuucauuuuucuauuuuuuaugcuugugg

SEQ ID NO: 4252283 - RNA, 87 nt, Streptococcus pneumoniae R6
gggauuuugcccaagauugucuugauuaucuuaacaacaaccuuucccaucaucguuaguauuuuggacgguuuuaggcauugugac

SEQ ID NO: 4252284 - RNA, 80 nt, Streptococcus pneumoniae R6
aggauguucccaaagcuuugucuugcuugaaucuucuuuuugacaaugguaagagcaugacucguuuugugaccgaucuu

SEQ ID NO: 4252285 - RNA, 57 nt, Streptococcus pneumoniae R6
ggugauauuaccaacaguuucucaaaccaaauuguuaagggaauugaggauaucgcc

SEQ ID NO: 4252286 - RNA, 113 nt, Streptococcus pneumoniae R6
gggccagcuaaggucuuugacucagaagaagaugcgauucaggccguucugacagaugaaaucguugauggcgauguagucguuguucguuuuguuggaccuaaagguggucc

SEQ ID NO: 4252287 - RNA, 79 nt, Streptococcus pneumoniae R6
gacccguauucguuuagcaagguaaaauuaggaauuuuuaauaaguuauaaguauugcuaguuugcuuuuugaacgguc

SEQ ID NO: 4252288 - RNA, 64 nt, Streptococcus pneumoniae R6
ugaaauugcgaugaaguugauaccuuguucaagaccgaaacggauaucgucguuaucgcguuca

SEQ ID NO: 4252289 - RNA, 73 nt, Streptococcus pneumoniae R6
ucgguguuaaauuuagcgauagugacuugauuggucuuccaauccguaucacuguugguaaaaaagcggccga

SEQ ID NO: 4252290 - RNA, 61 nt, Streptococcus pneumoniae R6
aagaaugggcaugcuuuugauacucccugcgauauaaguccucaagaggugcuauauucuu

SEQ ID NO: 4252291 - RNA, 72 nt, Streptococcus pneumoniae R6
gaugacgcaauuuuuuccuguggugauuauauuucaaaauuaacuucagaaggagaaauuguacuuguuauu

SEQ ID NO: 4252292 - RNA, 56 nt, Streptococcus pneumoniae R6
cuuugcugaugauaggcuacaaugcugcuaaaagugauuuaccuauuuuagcagag

SEQ ID NO: 4252293 - RNA, 61 nt, Streptococcus pneumoniae R6
agcuaagccuaaaauuggugccuaccacuuuaccacuauuguaccaaauuuagguaugguu

SEQ ID NO: 4252294 - RNA, 77 nt, Streptococcus pneumoniae R6
uguacgauaucuugacagaugagcgucuuaaccaucguguagagguugaaacgggaauuuuggaagaugaaugugca

SEQ ID NO: 4252295 - RNA, 129 nt, Streptococcus pneumoniae R6
aaggcaaucaaaucuuuuuugucacgauucauuaucuugagcaaguaguccaaagcaaaggccuuguugacaccuuuugggguacauucaaggauauugagcggaccuccccagguauugauagaaagu

SEQ ID NO: 4252296 - RNA, 67 nt, Streptococcus pneumoniae R6
cguacaguauggugauacuuugagcaccauugcagaagccuuggguguagaugucacagugcuugcg

SEQ ID NO: 4252297 - RNA, 116 nt, Streptococcus pneumoniae R6
gaaaugccaaagguugccuugaugucgucuggagaugacuuaucauuuaaggucaugaaaccgccauuacuuuccaaauaagucaaaaucaucugagcaucguuuuccaacauuuc

SEQ ID NO: 4252298 - RNA, 91 nt, Streptococcus pneumoniae R6
guuuggauaauguacauaaagaaaucuuguuuagcaggauugaauagaguuccugaagugaugacuucuuuauuagacauaaugucuggac

SEQ ID NO: 4252299 - RNA, 57 nt, Streptococcus pneumoniae R6
aauccaucucaguaaagaagcuaaaaaaucccggcucuuugucaacuguaguggguu

SEQ ID NO: 4252300 - RNA, 69 nt, Streptococcus pneumoniae R6
aguaccauuugcuauugguaaaguuuucaucccaucugauaacuuugacuacccaguagcaaacggucu

SEQ ID NO: 4252301 - RNA, 65 nt, Streptococcus pneumoniae R6
auuaucacuuucuagcuguucuuucaagagaauaauucgcuuaggacaauagaaaaguguauagu

SEQ ID NO: 4252302 - RNA, 65 nt, Streptococcus pneumoniae R6
cugaaauuccaaauagucuggaaauugcccacaagcgugguaucaagauugucuggaccauucag

SEQ ID NO: 4252303 - RNA, 71 nt, Streptococcus pneumoniae R6
cuaggauaaagcaaaacgcauaguaucaaggguuuucaacacuugauacuaugcguuuucugauguuaaag

SEQ ID NO: 4252304 - RNA, 77 nt, Streptococcus pneumoniae R6
uuuuauuaguaaguauauuaaguauggugaaccuaacaagccaguuacaacaccuacuggauaucuagcugguaaaa

SEQ ID NO: 4252305 - RNA, 71 nt, Streptococcus pneumoniae R6
aguuagaauauggaaauagguuggcaauuuuggcgcucaaaagaccaccuguuuccuauugguacuugacu

SEQ ID NO: 4252306 - RNA, 62 nt, Streptococcus pneumoniae R6
gauugccuggccgacuucuucuuucgucagaagugguacuucuaagaagcgcucaggcgauu

SEQ ID NO: 4252307 - RNA, 63 nt, Streptococcus pneumoniae R6
gguagccgugcaguucgcuacaucaacguuccaauggagcgcuugaaagaauuggcgauugcc

SEQ ID NO: 4252308 - RNA, 75 nt, Streptococcus pneumoniae R6
gaagucuauugaaaaaucuccagacuagagaacucacggauaguuccuaaucuggagauuucuuauuugcacuuu

SEQ ID NO: 4252309 - RNA, 110 nt, Streptococcus pneumoniae R6
ggaugauugaaaaaauggaacugggggaauuuuacaaggaauuacguuuggcgagaaagcuuaagcagacagauguggcuugugagggucuaacagcuucucaguugucc

SEQ ID NO: 4252310 - RNA, 58 nt, Streptococcus pneumoniae R6
aaaaaaacuccguagucucuagcgcuauaaauccggcuagagauuacagaguuauuuu

SEQ ID NO: 4252311 - RNA, 96 nt, Streptococcus pneumoniae R6
gguauuggagguuacacuccaccagauacuauuucaggugcgauuauugguacugcauuugguauuuuaucuggucaaggagaaacugcugguauc

SEQ ID NO: 4252312 - RNA, 65 nt, Streptococcus pneumoniae R6
uuucauuuugugguauaauugaaauaauuguaacgaaucaaggucaaucuagacacaaaauggaa

SEQ ID NO: 4252313 - RNA, 55 nt, Streptococcus pneumoniae R6
aaaagagccucauaaaagguauugcaacuugguaauaccuuuuugaggugcuuuu

SEQ ID NO: 4252314 - RNA, 59 nt, Streptococcus pneumoniae R6
uacugggaaagucggaacgaugauugaauuaccgucagcguauuuugacuuaucuagua

SEQ ID NO: 4252315 - RNA, 73 nt, Streptococcus pneumoniae R6
gugugcucagcuccaacaaauacuuucaacuucauaccuugagcgcguccaaguguauuguguggaagcauac

SEQ ID NO: 4252316 - RNA, 60 nt, Streptococcus pneumoniae R6
acuugugauucugauaagaaucgguugagcuaaagcgagccccuuagcggauauccaagu

SEQ ID NO: 4252317 - RNA, 86 nt, Streptococcus pneumoniae R6
uuugcuguugccaguauuaccgacuauuuagauggauauuuagcucguaaauggaauguggucaguaauuuugguaaauuugcaga

SEQ ID NO: 4252318 - RNA, 61 nt, Streptococcus pneumoniae R6
acggagcuuauaugcguuauacaacuauccaaaacuggucugauaacgucuauaacuuggu

SEQ ID NO: 4252319 - RNA, 72 nt, Streptococcus pneumoniae R6
uaaauaguuggugugcugcuuacaauauccauuuuaauaauggauauuguaagcagcauaccaaugaauuua

SEQ ID NO: 4252320 - RNA, 76 nt, Streptococcus pneumoniae R6
ggucaagaaguaagcuuuacuucuaaaguguauccugauaaaaaauggacugggaaauuaagcuauauuucugacu

SEQ ID NO: 4252321 - RNA, 83 nt, Streptococcus pneumoniae R6
ugcgugauauuaccaagguguuugguggauuuguugccaacgacaaaaucaacuugcaccuacgaaaaggugaaauucaugca

SEQ ID NO: 4252322 - RNA, 57 nt, Streptococcus pneumoniae R6
gaaugcuuacuucacuucuguaaacacaacguguuugcgaaguuuuggugaguauuu

SEQ ID NO: 4252323 - RNA, 73 nt, Streptococcus pneumoniae R6
gaaggcuuucagcuguugccauaaccucugcagauacuuuuucaggguugauaaccaacugcaugauuccuuc

SEQ ID NO: 4252324 - RNA, 55 nt, Streptococcus pneumoniae R6
auuuuaccauugccgcuaaacaugcgauugcuguugaggcaaauacugguaaaau

SEQ ID NO: 4252325 - RNA, 66 nt, Streptococcus pneumoniae R6
ucaaguuucucaguuuaguucaagugaauuaguuucaauuauugauaacgaaauugaggaauuuga

SEQ ID NO: 4252326 - RNA, 108 nt, Streptococcus pneumoniae R6
aagaaagcaaggacaaagcuucaaacagcuuucaaaaagauuugguguggauguuucuggucuaaagucaucugaaucuuugagaugagcuuuauaaauugcuuuuuu

SEQ ID NO: 4252327 - RNA, 56 nt, Streptococcus pneumoniae R6
gcggcugcgaaugaaaauuuuggaaauuucuuugcucaaaauacguuuguaggugc

SEQ ID NO: 4252328 - RNA, 68 nt, Streptococcus pneumoniae R6
cggcaaauuauucccugcagcaagauaaauuucauaccauucuuuucuuguuaagcuaaaguuugccg

SEQ ID NO: 4252329 - RNA, 100 nt, Streptococcus pneumoniae R6
ggaauccaguuuuaucauugucagcaacuugaccgacaacuccacgaacucccccuguuuucgguucgagagcuacacuuccugauugagcaaacguucc

SEQ ID NO: 4252330 - RNA, 80 nt, Streptococcus pneumoniae R6
gacuagggcgauaaaguuucucaacugucagaauaucagucuugauuuggacauuugacaaggcuuuauugaucaugguc

SEQ ID NO: 4252331 - RNA, 85 nt, Streptococcus pneumoniae R6
ggcuccaagacgguugcggauuucaacuucuggugucaguuugaaaucauuccagaguucauccagcaccguauuacuugguguc

SEQ ID NO: 4252332 - RNA, 72 nt, Streptococcus pneumoniae R6
ugacuuuguccuuuguauugggcaagcugguggaagaacuaguuugacaccugaacgaguggccauuaauca

SEQ ID NO: 4252333 - RNA, 103 nt, Streptococcus pneumoniae R6
gcaucaguuaguuguuuacuugcuucaucauucauagaacuacuauaccauauuuuguuucgcaggaagucuauuggaaaguaagaaauauugaagcugaggc

SEQ ID NO: 4252334 - RNA, 112 nt, Streptococcus pneumoniae R6
gcucuuucaucucacgcgcagccuuguugguaaagguaauggccaagauauuccaaggauugaccagcuuuucaucaaucaaauaagcgauacgguggguuaaaacacgagu

SEQ ID NO: 4252335 - RNA, 57 nt, Streptococcus pneumoniae R6
gauauggucugccgucuugauaacauccagauugugcucgaugacgaggacuguauu

SEQ ID NO: 4252336 - RNA, 58 nt, Streptococcus pneumoniae R6
ucguuuugcgauuugaggauaagcuucuucauaagcccguaucccaucagcaggaugg

SEQ ID NO: 4252337 - RNA, 96 nt, Streptococcus pneumoniae R6
aguuacuuccaaaacauguacgccuucuuuacaacuggaucggacguaucaaauguuacucugacauugagucgugaagcuggugaugaagcaacu

SEQ ID NO: 4252338 - RNA, 98 nt, Streptococcus pneumoniae R6
gugauuucauaguuauucccuugggcaaaggcuucuugaaccugagcuagauuuaucauugguguagaaaccugcuccaagggaaaggcugaaauggc

SEQ ID NO: 4252339 - RNA, 113 nt, Streptococcus pneumoniae R6
cguggaacuggaauuccauuguuaaugcguuuugcaaucguaugugcaucuuugauauuugagaaauaaaagaguacauaaacgauuacaaagauuagauggaaggcaccacg

SEQ ID NO: 4252340 - RNA, 64 nt, Streptococcus pneumoniae TIGR4
ucagucuuuaaaaagccuauuguaucaagcuuucuagcuuggucaguagguuuuuuaauuauga

SEQ ID NO: 4252341 - RNA, 129 nt, Streptococcus pneumoniae TIGR4
gaagcgguuaguauuccaguaauggcuaaggucagaaucgggcauuuuguugaagcucagauuuuagaggcuauugaaauugauuauaucgacgagagugaaguucuaucuccagcugaugaccguuuc

SEQ ID NO: 4252342 - RNA, 77 nt, Streptococcus pneumoniae TIGR4
auucuuccuucuuuuucagcaaccagaaaagaggucugaauuucucucaaaugugcuucaaagacagaaggaggaau

SEQ ID NO: 4252343 - RNA, 60 nt, Streptococcus pneumoniae TIGR4
uucugugauggucuugccauccaacaucgaccaauggacaccuuccaagacauuacggaa

SEQ ID NO: 4252344 - RNA, 56 nt, Streptococcus pneumoniae TIGR4
guaccuguaucaucaaccaagucuuuuacaggacauuugcugggggcugcgggugc

SEQ ID NO: 4252345 - RNA, 61 nt, Streptococcus pneumoniae TIGR4
ucuggcuccauuuggaauccuuggucuuguuuuuaaaaccauuucugacaagggagucgga

SEQ ID NO: 4252346 - RNA, 84 nt, Streptococcus pneumoniae TIGR4
gggauugcgcuagccuuugagggggaugcgguguauucuauguauauucgccgucaccucauccucaaagguaugaccaaaccc

SEQ ID NO: 4252347 - RNA, 80 nt, Streptococcus pneumoniae TIGR4
gaaccuuggauaacuggaagaucgucaccugggaagucguauucugacaauaggucacggauuuccauuucaaccaauuc

SEQ ID NO: 4252348 - RNA, 64 nt, Streptococcus pneumoniae TIGR4
cucaaaacaguguuuugagguuguagauagaacugacgaagucagcucaaaacaccguuuugag

SEQ ID NO: 4252349 - RNA, 78 nt, Streptococcus pneumoniae TIGR4
ucaaaucaaguuugcauuaagagauucgagaggacuuucuuugagcuuuuugaagcaagcuauuuccuauuugauuga

SEQ ID NO: 4252350 - RNA, 81 nt, Streptococcus pneumoniae TIGR4
ccgcagauugcucaaaacaguguuuugagguuguagauggaacugacguagucagcucaaaacacuguuuugagguugugg

SEQ ID NO: 4252351 - RNA, 56 nt, Streptococcus pneumoniae TIGR4
ccugucuucaaaucagauuucuuugaaugaaacgguagaaaugauggggagacagg

SEQ ID NO: 4252352 - RNA, 73 nt, Streptococcus pneumoniae TIGR4
ucguugaaauuacuugauuguauuuuggauuaucaagaaagauucaauggaaaaacaugucaaguaucaacga

SEQ ID NO: 4252353 - RNA, 68 nt, Streptococcus pneumoniae TIGR4
gauaagcuagaacaguaucgagaacuggauuuaucugugucuaguuuucgauuagauguucuuuuauc

SEQ ID NO: 4252354 - RNA, 130 nt, Streptococcus pneumoniae TIGR4; identical to SEQ ID NO: 4252141

SEQ ID NO: 4252355 - RNA, 126 nt, Streptococcus pneumoniae TIGR4
caugugguuuuugauaaucacucgccauuuuagcuaagaauuuguuguaagaaacgccugcggaagcaguuagauggaguucuugccagauaucuuuuugaaugaggcgagcaauuuugaccgcug

SEQ ID NO: 4252356 - RNA, 56 nt, Streptococcus pneumoniae TIGR4
uacaaaagcgcauaguaucaaggcuuuauagaaucuugauacuaugcgcuuuugug

SEQ ID NO: 4252357 - RNA, 57 nt, Streptococcus pneumoniae TIGR4; identical to SEQ ID NO: 4252135

SEQ ID NO: 4252358 - RNA, 58 nt, Streptococcus pneumoniae TIGR4; identical to SEQ ID NO: 4252310

SEQ ID NO: 4252359 - RNA, 78 nt, Streptococcus pneumoniae TIGR4
cgccuauuggaauuguuauugaugcggcaauuaucacucaaaagugugaugcguccaucuugguaacagcaacaggug

SEQ ID NO: 4252360 - RNA, 95 nt, Streptococcus pneumoniae TIGR4
guauacucugcauugcuguuagaguacucauuagcugaauuagacaacaucuucuucauaaagacagguacuauaaucggcaaugcugauaauac

SEQ ID NO: 4252361 - RNA, 68 nt, Streptococcus pneumoniae TIGR4
gagaguuuuucgcauugaugaauugauuuaacaaucuaucuuuuaauucauauggaagagaagcuguc

SEQ ID NO: 4252362 - RNA, 55 nt, Streptococcus pneumoniae TIGR4
agggcagcuucaccugucaaaaguuuugcaaauucuucugauacuggagcuccuu

SEQ ID NO: 4252363 - RNA, 57 nt, Streptococcus pneumoniae TIGR4
ugaaaaauaugaagaaagugcguucccaggacaugggagcgcacuucgucauacuca

SEQ ID NO: 4252364 - RNA, 61 nt, Streptococcus pneumoniae TIGR4
guuccauaagauacuuucuaaugaguuguuuaggcgcuuuucauuauaagucuuaugggac

SEQ ID NO: 4252365 - RNA, 59 nt, Streptococcus pneumoniae TIGR4
ccaauuucugcuauggaugcaggggcugauauggcagcaguuuccaugcauaagucugg

SEQ ID NO: 4252366 - RNA, 93 nt, Streptococcus pneumoniae TIGR4
gggacaggagacuugguuggagccuuaacagcuguuuuucucagccaaggaaagacugguuuugaagcuucuugcuuagcagucucuuaucuc

SEQ ID NO: 4252367 - RNA, 57 nt, Streptococcus pneumoniae TIGR4
uagcaucugcuucccuacuugccuuaaggguuucaucagguaagggaggucaugcug

SEQ ID NO: 4252368 - RNA, 80 nt, Streptococcus pneumoniae TIGR4
cuguugcagcgauugguguaaagauaucguaaccuuucauaaggucuucguuuacaucuuucaccauaacugcaucacag

SEQ ID NO: 4252369 - RNA, 61 nt, Streptococcus pneumoniae TIGR4
gugggcauaaugcgcgugaggaauuacagcgagcgguuaugcaugcggaaauuauggcuau

SEQ ID NO: 4252370 - RNA, 81 nt, Streptococcus pneumoniae TIGR4
uacuuaaucucuaaguaaguccccuaaauagacauggcaaaaacggccauaucucacugcugacuuacuuauuguuaggug

SEQ ID NO: 4252371 - RNA, 89 nt, Streptococcus pneumoniae TIGR4
cuagccgcaaucagcucaaaacacuguuuugagguuguagauagaacugacgaagucagcucaaaacacuguuuugagguuguggauag

SEQ ID NO: 4252372 - RNA, 68 nt, Streptococcus pneumoniae TIGR4
gauauaaguuuugcuacuguugauuugccugauccagaugaaccgacaagugcguaggacuuuccuuc

SEQ ID NO: 4252373 - RNA, 70 nt, Streptococcus pneumoniae TIGR4
acuucuguuuggucucagcaucuaccacgaccuuuuccuuguccaaauaacugggacuaacauagagcgu

SEQ ID NO: 4252374 - RNA, 74 nt, Streptococcus pneumoniae TIGR4
caucugugggauuauuucauugauuauuaccuugacaaauguucguaaaaugaucauugaaucgauucccaaug

SEQ ID NO: 4252375 - RNA, 97 nt, Streptococcus pneumoniae TIGR4
uccuaguuuacuuuuugauuuuuauugaguauaagaggucuuuccuaagcaguuagaggagaauuuugcuauacugauacuaguaagugguaaagga

SEQ ID NO: 4252376 - RNA, 89 nt, Streptococcus pneumoniae TIGR4
cuuaaggauauuucacuagugcuccauggaccaacaauuaccggcaucauugguccaaacggcgcugggaaaucaacacuauuaaaagg

SEQ ID NO: 4252377 - RNA, 69 nt, Streptococcus pneumoniae TIGR4
ucaagauaaaaacgaacaaguucucuucugaauaacagaaaaagagccuguucguuuuuuguuauauga

SEQ ID NO: 4252378 - RNA, 77 nt, Streptococcus pneumoniae TIGR4
aagucuuugauauagaaaaacgcauaguaucagguguuucaacaccugauacuaugcguuuuauugugggaagauuu

SEQ ID NO: 4252379 - RNA, 55 nt, Streptococcus pneumoniae TIGR4
gagauuuuaggugauaccauugauauccacggugguggagcugaccuagaguuuc

SEQ ID NO: 4252380 - RNA, 66 nt, Streptococcus pneumoniae TIGR4
gaccagguagccguccauugaaaucauugagccacaugcuuaaagguaaacaaggacgcuuccguc

SEQ ID NO: 4252381 - RNA, 56 nt, Streptococcus pneumoniae TIGR4; identical to SEQ ID NO: 4252276

SEQ ID NO: 4252382 - RNA, 55 nt, Streptococcus pneumoniae TIGR4; identical to SEQ ID NO: 4252271

SEQ ID NO: 4252383 - RNA, 124 nt, Streptococcus pneumoniae TIGR4
uuuaugucgacaucuauuaaaguuagguucuuaauggcuuuguagacagcuccagcuacaaguaguguguaggaugguaauuugucauaggggagauuugguuuaagauggagugucauauaaa

SEQ ID NO: 4252384 - RNA, 74 nt, Streptococcus pneumoniae TIGR4
gaaaccaauggcuugcguugaauugugauuguuuggaugccuguaucauauaaucguaccaauccauugucuuc

SEQ ID NO: 4252385 - RNA, 55 nt, Streptococcus pneumoniae TIGR4
gaacucuauuuucagacuugagcaucugcagcugcauuuggaaauaaaagaguuc

SEQ ID NO: 4252386 - RNA, 99 nt, Streptococcus pneumoniae TIGR4
uccgaucccuauggcggguguucccuaucauucugcccaacaguauaucgaugucuugauugagcaggguuauaagguggcuaucgcagagcagaugga

SEQ ID NO: 4252387 - RNA, 73 nt, Streptococcus pneumoniae TIGR4
uccuuauauuauguguuauaaugaagugugacuauucucugaucuagucuuccaguaugacucauguaaagga

SEQ ID NO: 4252388 - RNA, 57 nt, Streptococcus pneumoniae TIGR4
gaaugcuuauuuaaccucuguaaacacaacguguuugcgaaguuuuggugaguauuu

SEQ ID NO: 4252389 - RNA, 79 nt, Streptococcus pneumoniae TIGR4; identical to SEQ ID NO: 4252218

SEQ ID NO: 4252390 - RNA, 85 nt, Streptococcus pneumoniae TIGR4
ggaaaugggcuuugaugcgacccguuuguucgacgaacgacugacaagucuaaucgcucgaaaugaggugcaaaaugcuugaucc

SEQ ID NO: 4252391 - RNA, 64 nt, Streptococcus pneumoniae TIGR4
cucaaaacacuguuuugagguugcaaauagaacugacgaagucagcucaaaacaccguuuugag

SEQ ID NO: 4252392 - RNA, 63 nt, Streptococcus pneumoniae TIGR4
cucaaacaguguuuugagauugcagauaagacugacggagucagcucaaagcacugcuuugag

SEQ ID NO: 4252393 - RNA, 55 nt, Streptococcus pneumoniae TIGR4
aucgucgcaaacaaaucuuccaagguauagccauuuggagcuuuguaugugugau

SEQ ID NO: 4252394 - RNA, 79 nt, Streptococcus pneumoniae TIGR4
uccaagaagcuuuagcccguuauagugaaggucguaccaaaccgacuauucagcguuauaaggggcuaggugaaaugga

SEQ ID NO: 4252395 - RNA, 79 nt, Streptococcus pneumoniae TIGR4
gcaucaacggaguugagauucagguauuuucuagugaaaaaggauuggaggucuaccaugguucagaacaguuguuggc

SEQ ID NO: 4252396 - RNA, 61 nt, Streptococcus pneumoniae TIGR4
ggucggucagaguggauuuugauuuuccccuucauuccgauccagauuaccaugauugacc

SEQ ID NO: 4252397 - RNA, 78 nt, Streptococcus pneumoniae TIGR4
ugcaaacuuuauuuuccaaaugagcaaauugacacuguauuuacaacagaacaauuuaagaguguggaagauauugca

SEQ ID NO: 4252398 - RNA, 61 nt, Streptococcus pneumoniae TIGR4
guaggagaaucaaaaacagguucagguaagacucauacuuucuuguuaccgauuuuccagc

SEQ ID NO: 4252399 - RNA, 71 nt, Streptococcus pneumoniae TIGR4
gggcaggcuuuggaggagcuguucuuccaguauggacgguauuuauugauuaguucguccagagacugccc

SEQ ID NO: 4252400 - RNA, 91 nt, Streptococcus pneumoniae TIGR4; identical to SEQ ID NO: 4252254

SEQ ID NO: 4252401 - RNA, 66 nt, Streptococcus pneumoniae TIGR4; identical to SEQ ID NO: 4252238

SEQ ID NO: 4252402 - RNA, 58 nt, Streptococcus pneumoniae TIGR4
ugguugcagaaaagcaugauguuuugcugauugagcaagacgaagcuguucucaauca

SEQ ID NO: 4252403 - RNA, 67 nt, Streptococcus pneumoniae TIGR4
uuguuaaaccuuucgcuuuucaugguaggauggcucucugucauuuuacuugaaagugauuuggcag

SEQ ID NO: 4252404 - RNA, 64 nt, Streptococcus pneumoniae TIGR4
cucaaaacacuguuuugagguuguggauagaacugacgaagucagcucaaaacacuguuuugag

SEQ ID NO: 4252405 - RNA, 80 nt, Streptococcus pneumoniae TIGR4
cuguugcagcgauugguguaaagauaucguaaccuuucauaaggucuucguuuacaucuuucaccaugacugcaucacag

SEQ ID NO: 4252406 - RNA, 75 nt, Streptococcus pneumoniae TIGR4
guuucggcuccuuuuuucuaggagugaaguauguuagaaaauggcgauuugauuuuugugagagaugggucagac

SEQ ID NO: 4252407 - RNA, 108 nt, Streptococcus pneumoniae TIGR4
gaaaacgcauaguaucagguguugaauauguacugccccccaaaaguuagauuuuuucugucuaacuuuugggggcaguucauaagaaccuugguaauaugcguuuuu

SEQ ID NO: 4252408 - RNA, 78 nt, Streptococcus pneumoniae TIGR4
ugaccuugguaguuguuccaaucugcaccauguuaaccauuaugacaaauguagccaugaauaacaaagcagggguua

SEQ ID NO: 4252409 - RNA, 70 nt, Streptococcus pneumoniae TIGR4
gucagaaauggauaaaaucaucuggucuucaguugucuucauucugacagugauuuuacccccaucuggc

SEQ ID NO: 4252410 - RNA, 74 nt, Streptococcus pneumoniae TIGR4
acaaaggauuuuuggcucuauaauauuuguaguggguaaaucccuuauagauauuauggagccuauuuuauugu

SEQ ID NO: 4252411 - RNA, 72 nt, Streptococcus pneumoniae TIGR4
ugaauuugccaucgguaugggaccuaaaauuuuugcucacauuggcaaggauggaacggccuauaccauucg

SEQ ID NO: 4252412 - RNA, 77 nt, Streptococcus pneumoniae TIGR4
uguaaguuacaucuaguugagagagguaugaaugauuuggguuaaacauucuuacaaucucucaaacaguucuugca

SEQ ID NO: 4252413 - RNA, 80 nt, Streptococcus pneumoniae TIGR4
cuugccuuccaugcccuacucagcguaagauuucuauacuaguauagacgucuuggcggaguuagauaauggaauccaag

SEQ ID NO: 4252414 - RNA, 63 nt, Streptococcus pneumoniae TIGR4
ugagaaaagagacauauuuaugaaaaagcuccaucgugcuuuuaauguguucucuuguuuuca

SEQ ID NO: 4252415 - RNA, 64 nt, Streptococcus pneumoniae TIGR4
cucaaaacagugucuugagcugacuucgucaguucuaucugcaaccucaaaacacuguuuugag

SEQ ID NO: 4252416 - RNA, 112 nt, Streptococcus pneumoniae TIGR4
ugaugcugaaccuguguuagguaauuguuugccagcaggugacugguagguaacaucuugcauuguuccugcaguugcuugcggugcacuuguugucuuaggagcagcauua

SEQ ID NO: 4252417 - RNA, 79 nt, Streptococcus pneumoniae TIGR4
ggugacgaggguccauguuggcuuggauuuuaaagacaaagccugagaaauccuugucauaaggauccacaauuucacc

SEQ ID NO: 4252418 - RNA, 60 nt, Streptococcus pneumoniae TIGR4
ugacaccauagauuggugguugggcaauauaaacauaaccagcuucuaggauugguuuca

SEQ ID NO: 4252419 - RNA, 105 nt, Streptococcus pneumoniae TIGR4
ucaugacuugggcaauggcugugcguucuucagguguuucccccuucaucuuaagagcuaagaggagagaagcaaucugcgcuucaguuacacgcccaguuacga

SEQ ID NO: 4252420 - RNA, 66 nt, Streptococcus pneumoniae TIGR4
agguugguuggauuaaaguuucuucaacaaacucuucaaagaaggcauugaugaugugaccaaccu

SEQ ID NO: 4252421 - RNA, 71 nt, Streptococcus pneumoniae TIGR4
uucugcuuaaaauucguauuggcaagcuugaaguaaguuuuuuucaaucucucaaucucgaaaugguagaa

SEQ ID NO: 4252422 - RNA, 64 nt, Streptococcus pneumoniae TIGR4
agacagaaaaaucaaaguuugauagcuauuuggauagcagucaggcuuugauuuuuuacagucu

SEQ ID NO: 4252423 - RNA, 96 nt, Streptococcus pneumoniae TIGR4
uguuuuaaacguucaauccguucugagauagguggguggguauaaaagaguuuuuggaaccccccaccuuucuuaggaucauugauauaaagggca

SEQ ID NO: 4252424 - RNA, 68 nt, Streptococcus pneumoniae TIGR4
ggauuccuuucauguauucagaagagguauauugccaaccuuuuuuuccugaauaaugaggguuuucc

SEQ ID NO: 4252425 - RNA, 70 nt, Streptococcus pneumoniae TIGR4; identical to SEQ ID NO: 4252172

SEQ ID NO: 4252426 - RNA, 63 nt, Streptococcus pneumoniae TIGR4
ucuuguuuagguaauaguuugacugucaaauuauggugaaaucgaacuauuacguaagcaagg

SEQ ID NO: 4252427 - RNA, 108 nt, Streptococcus pneumoniae TIGR4
aucauuguucuugcgaaugacaguugaaguugaaauagacaacugaugaucaaugucggucauagaagucuuuuuaauuagcuucugagcaaucuuuugguugaugau

SEQ ID NO: 4252428 - RNA, 55 nt, Streptococcus pneumoniae TIGR4
cagaaaaacacuucugcucucuaguuucugcuagugaacaaaaguguuuuuucug

SEQ ID NO: 4252429 - RNA, 80 nt, Streptococcus pneumoniae TIGR4
uguaauuguuccauaugaaucuuucuaaugaguuguuuugucgcuuuucauuauaggucauaugggacuuuuuuucuaca

SEQ ID NO: 4252430 - RNA, 121 nt, Streptococcus pneumoniae TIGR4
gaaaaugggggagcauccgaugcugcuucuuuuucuuagcuauaguacuguuauauccauucuugcacaaaauuggaugggucuuguggcuucaguaggaauguuucuauuuacuauuuuc

SEQ ID NO: 4252431 - RNA, 56 nt, Streptococcus pneumoniae TIGR4
ugauugagugcuuucuugaggcaauucacuuggugcaaggaaggucaucucaauca

SEQ ID NO: 4252432 - RNA, 60 nt, Streptococcus pneumoniae TIGR4
ggcguuauuaucgguacuccugaguaugaucacucuauuccagcuguuuugaugagcgcu

SEQ ID NO: 4252433 - RNA, 62 nt, Streptococcus pneumoniae TIGR4
guacuaggaagcucguuuaagguugaguuucuugcaaaucuuguuagcguucuuccuuuugc

SEQ ID NO: 4252434 - RNA, 72 nt, Streptococcus pneumoniae TIGR4
cagcccuuuuuuuaacucucuacagagguguuccuaaucguaucgaugcuucuagcguugagaaaaugguug

SEQ ID NO: 4252435 - RNA, 77 nt, Streptococcus pneumoniae TIGR4
uuuuuauuguuggcucuauaauauuuguaguggguaaauccccuauagauauuauggagccuauuuuauuguagaaa

SEQ ID NO: 4252436 - RNA, 80 nt, Streptococcus pneumoniae TIGR4; identical to SEQ ID NO: 4252164

SEQ ID NO: 4252437 - RNA, 68 nt, Streptococcus pneumoniae TIGR4
auuuuaggucacuugauagcuauauuuauuucaucagauuuaaacgcuuuagcuaugggugaugaaau

SEQ ID NO: 4252438 - RNA, 73 nt, Streptococcus pneumoniae TIGR4
ucucaggauuuugaauaaucuccugaguaauggcuucauggucuguaucaaagagauguucaaaaguauggga

SEQ ID NO: 4252439 - RNA, 77 nt, Streptococcus pneumoniae TIGR4
acaguggcuucugucuuggaagucaagucuuuugccaagucuugauuaaaguucaagacaaggaaaucagcugcugu

SEQ ID NO: 4252440 - RNA, 100 nt, Streptococcus pneumoniae TIGR4
acaggaggaauugaugaugucgaugcuccuuucauggaacaaaucaagcaccaggcagaaauugccauggaagaagcagauguuaucguuuuugucgugu

SEQ ID NO: 4252441 - RNA, 69 nt, Streptococcus pneumoniae TIGR4
gugacacgaucuucaugaagccaccuucacgcaauucacgugcaacugggccaaagauacguguuccgc

SEQ ID NO: 4252442 - RNA, 84 nt, Streptococcus pneumoniae TIGR4
ggaaaaauaggagcaucuuuauuggaagaagcuugauuucccgcaaucauagauucuucuucaauauagauagucauauuuucc

SEQ ID NO: 4252443 - RNA, 55 nt, Streptococcus pneumoniae TIGR4
aaauggcgguucaggagcguuugaaaauugaucaggcugcuuugacacggcauuu

SEQ ID NO: 4252444 - RNA, 55 nt, Streptococcus pneumoniae TIGR4
aaaacgacucauuuucucuaacuugaaaaauagauuagagaaaauggguuguuuu

SEQ ID NO: 4252445 - RNA, 64 nt, Streptococcus pneumoniae TIGR4
uauuuuuaagaagauguuauaaggcaguaauuugaaacugccuuuuaauaaggauuuaagaaua

SEQ ID NO: 4252446 - RNA, 65 nt, Streptococcus pneumoniae TIGR4
uuccuucgucaggcaauucaauaucagggauuaccuuuugauguuagacuagacgaaaaucggaa

SEQ ID NO: 4252447 - RNA, 105 nt, Streptococcus pneumoniae TIGR4
gaaggcaagaugaaccugucugucaaagauauugaaggagaaauccucucuauuucucaguuuacccucuuugcggauacuaagagaggcaaucguccagccuuu

SEQ ID NO: 4252448 - RNA, 56 nt, Streptococcus pneumoniae TIGR4; identical to SEQ ID NO: 4252327

SEQ ID NO: 4252449 - RNA, 66 nt, Streptococcus pneumoniae TIGR4
cugagcaaggugcaaacauuucugaccaauggaccgguucagaauugccacuugccuuugcuucag

SEQ ID NO: 4252450 - RNA, 71 nt, Streptococcus pneumoniae TIGR4
uggugauguuggaaauguuguucuucgugaccguaaggucuugucagaggauggaauuuucaucguggcua

SEQ ID NO: 4252451 - RNA, 89 nt, Streptococcus pneumoniae TIGR4
cagguugcucaaaguacugcuuugagguuguagauagaacugacgaagucagucacauauauaauccaaggugacguugacgcgguuug

SEQ ID NO: 4252452 - RNA, 88 nt, Streptococcus pneumoniae TIGR4
uggucuagaauuggcuguagauaaagaauuaguugcuuauaaaguagauaguaauaauucauugcaguacagccaaggucauagauua

SEQ ID NO: 4252453 - RNA, 77 nt, Streptococcus pneumoniae TIGR4
guggaaaauauuugcuuuuuuaucugacagacaaggucuugauuucccauuugcggauggagggcaaguauuuuuac

SEQ ID NO: 4252454 - RNA, 96 nt, Streptococcus pneumoniae TIGR4
gaagaagaaauuaccugauauuauuaaagguggaauuaagaccuuuguugguuucuuaguuguaucugguggugcaggaauuguacaaaauucuuu

SEQ ID NO: 4252455 - RNA, 59 nt, Streptococcus pneumoniae TIGR4
aucuugaauuguaagugauugaggauaguggcuaucaauuaaucguuugcauucaagau

SEQ ID NO: 4252456 - RNA, 106 nt, Streptococcus pneumoniae TIGR4
ggcuuauuucaaaacgcauuauccagccauuuuuuaucaggucauguuaaauucuuccaacagugauuacuuaauagaugcacuugaagcagguuuugaaguagcc

SEQ ID NO: 4252457 - RNA, 80 nt, Streptococcus pneumoniae TIGR4
ugagaaauuuuucggacucauugaggacaaucugaagcagguucauccucuuuuucagacugucuuuaaaaccuuucuca

SEQ ID NO: 4252458 - RNA, 61 nt, Streptococcus pneumoniae TIGR4; identical to SEQ ID NO: 4252168

SEQ ID NO: 4252459 - RNA, 76 nt, Streptococcus pneumoniae TIGR4
uuacugguugguaguuuucuauuuuuagcugcuauuuugacuauuugcuuuaucaaggaagauuuucaaccaguag

SEQ ID NO: 4252460 - RNA, 64 nt, Streptococcus pneumoniae TIGR4
ucgcuuucuauucguccuuuguaucuuauuuaaugucgcccugagaggcgacgaauagaaagga

SEQ ID NO: 4252461 - RNA, 66 nt, Streptococcus pneumoniae TIGR4
acagcugguuugaggccuugaagagcggcuuuuagguuggcuacaagcgugucaagcucagcuugu

SEQ ID NO: 4252462 - RNA, 73 nt, Streptococcus pneumoniae TIGR4; identical to SEQ ID NO: 4252150

SEQ ID NO: 4252463 - RNA, 56 nt, Streptococcus pneumoniae TIGR4
uguuguaggugaaauuguugagaugguagcccauccagauagugaccaccucaaca

SEQ ID NO: 4252464 - RNA, 57 nt, Streptococcus pneumoniae TIGR4
auugaugaggaggagauuugcaauagaaguggcuaauaaauugacuccuuuaucaau

SEQ ID NO: 4252465 - RNA, 60 nt, Streptococcus pneumoniae TIGR4
guguuggguugauggcaguaaccaagaucaauuuaccgacuggauugcucucaacugcac

SEQ ID NO: 4252466 - RNA, 64 nt, Streptococcus pneumoniae TIGR4; identical to SEQ ID NO: 4252247

SEQ ID NO: 4252467 - RNA, 72 nt, Streptococcus pneumoniae TIGR4
uuuucggcucuauaauauuuguaguggguaaaucccuuauagauauuauggagccuauuuuguuguagaaaa

SEQ ID NO: 4252468 - RNA, 63 nt, Streptococcus pneumoniae TIGR4
ucauaaguaaggagagcauucagauugaaccauuaacuagaaaagguuuuccuuaugccuuga

SEQ ID NO: 4252469 - RNA, 102 nt, Streptococcus pneumoniae TIGR4
aggccaagccugucugguguucgcuauagccaggacgggcagaguaacggucagcugcugccuuuccaucuugguugacauaaucuugauagagcuuggucu

SEQ ID NO: 4252470 - RNA, 111 nt, Streptococcus pneumoniae TIGR4
gcuuuagaaaaaaguagauccagagauuuauuuaaaaagaauacuggugucgguccucaucgagaugacauuucuuuuuauauaaaugggauggaugcuaguuucggaagc

SEQ ID NO: 4252471 - RNA, 58 nt, Streptococcus pneumoniae TIGR4
ccguuuugcgauuugaggauaagcuucuucauaagcccguaucccaucagcaggaugg

SEQ ID NO: 4252472 - RNA, 57 nt, Streptococcus pneumoniae TIGR4
ccaagcguccgaauccgaaagagaucugcuugauuuuuuaucuuacuggucgcaugg

SEQ ID NO: 4252473 - RNA, 65 nt, Streptococcus pneumoniae TIGR4
uuuguaagacuuguaagaucuauuuugucaucucccuuaagauuuuucaauacaggucuuucaag

SEQ ID NO: 4252474 - RNA, 116 nt, Streptococcus pneumoniae TIGR4
cuuacgcuauuaucgucuuuaucacuagucgaucagaguuugcgacucuaaccuauaaauaccagguaucagcccuagauuuuguugauaaggauaucaaugaugagauguuuaag

SEQ ID NO: 4252475 - RNA, 61 nt, Streptococcus pneumoniae TIGR4; identical to SEQ ID NO: 4252205

SEQ ID NO: 4252476 - RNA, 84 nt, Streptococcus pneumoniae TIGR4
cuuaauacaacaggggcagucuugucuccauuugacagcuaccaguugcuucguggucucaagaccuugucucuucguauggag

SEQ ID NO: 4252477 - RNA, 55 nt, Streptococcus pneumoniae TIGR4
acaauaacccacaaugaggcuggcacaaucugcccagccucauauccguuauugu

SEQ ID NO: 4252478 - RNA, 59 nt, Streptococcus pneumoniae TIGR4; identical to SEQ ID NO: 4252186

SEQ ID NO: 4252479 - RNA, 98 nt, Streptococcus pneumoniae TIGR4; identical to SEQ ID NO: 4252338

SEQ ID NO: 4252480 - RNA, 64 nt, Streptococcus pneumoniae TIGR4
cucaaaacgguguuuugagcugacuucgucaguucuaucuacaaccucaaaacacuguuuugag

SEQ ID NO: 4252481 - RNA, 89 nt, Streptococcus pneumoniae TIGR4
cagguugcucaaagcacugcuuugagguuguagauaagacugacgaagucagucacauauauaauccaaggcgacguugacgcaguuug

SEQ ID NO: 4252482 - RNA, 80 nt, Streptococcus pneumoniae TIGR4
gcggaaaacucggaaaauagauaaucugacugaaaaaucaggauuucucgucagguuccuaauuuucagucguuuucuuc

SEQ ID NO: 4252483 - RNA, 111 nt, Streptococcus pneumoniae TIGR4
ucuacaagauuucccucaguagccacacuugcuucagcuggagcuggaacuucuucugcuacagucucugcuggagcagauguaggagcuacuggacucgguguugcuaga

SEQ ID NO: 4252484 - RNA, 85 nt, Streptococcus pneumoniae TIGR4
ugguuugagaaauuacaugauuuuccgcaauuacaaggaaaucuucaggccuuuaaugaugcggguuucauugaaaauuuugcca

SEQ ID NO: 4252485 - RNA, 59 nt, Streptococcus pneumoniae TIGR4; identical to SEQ ID NO: 4252233

SEQ ID NO: 4252486 - RNA, 77 nt, Streptococcus pyogenes M1 GAS
ucacguaaacaauugcaagaguuaauguugagucuucacaaggaauuugacaugacgauuguauuugugacacauga

SEQ ID NO: 4252487 - RNA, 114 nt, Streptococcus pyogenes M1 GAS
aguaacaagaaaauaaaccgaaaacgcugugacuauuuaauaaguuuucuaguuuaaaaaaacuagguuaauaagguuaaguuaauaagggcgcacgguggaugccuuggcacu

SEQ ID NO: 4252488 - RNA, 71 nt, Streptococcus pyogenes M1 GAS
gaaauaagaagugauugagauuagucuucuauugaaagaagccgcuaaugcuuaaucacuuuuuucauuuc

SEQ ID NO: 4252489 - RNA, 65 nt, Streptococcus pyogenes M1 GAS
auugaucaaugauauggucaaaauggcuaucaaccauaguuuuuugacggugaucaauaaucaau

SEQ ID NO: 4252490 - RNA, 85 nt, Streptococcus pyogenes M1 GAS
uaacuaugccuuaucugcuuugaaauuaggggcagaugauuacuugcucaaacccuuuuccaaggcagauguagaagacauguua

SEQ ID NO: 4252491 - RNA, 82 nt, Streptococcus pyogenes M1 GAS
ccacaaaaagcaagguuuugaugguuuguguuucaucuacugaaagaaaagcagccacuucaucaaucguuuugcaaugugg

SEQ ID NO: 4252492 - RNA, 68 nt, Streptococcus pyogenes M1 GAS
uaauccagcuuugcuuuaugguuuugaugcggguuauuuggcagaaaaugguccagcagauuugguua

SEQ ID NO: 4252493 - RNA, 67 nt, Streptococcus pyogenes M1 GAS
uuguuaguguuugaguaucuacggaugaccaauaaguuagcccaaggguacuucagcagucugacga

SEQ ID NO: 4252494 - RNA, 118 nt, Streptococcus pyogenes M1 GAS
gugaagaaauuuaaaacacuuaucacagguuuuaucaacacaagauuggguuuuauaauuacucuacucuuuuguuacuggauaaagacccugugggcauaucauacagacuuuucac

SEQ ID NO: 4252495 - RNA, 121 nt, Streptococcus pyogenes M1 GAS
agacaaggguguuauugaagcagcacaagcuucaggugcuacuuucugggauauugucaaaguguaucucagugaagguuuaccagaucuuauucguguuucuacagucaccuuaauuucu

SEQ ID NO: 4252496 - RNA, 65 nt, Streptococcus pyogenes M1 GAS
gguccgcaaaagaaauaggauguaagugaccaucgugguccacuaaaauacugucuuuuguuacc

SEQ ID NO: 4252497 - RNA, 80 nt, Streptococcus pyogenes M1 GAS
cgcauagccuuaaagauguaccaauugauaugaaguaugauagugacaaauauuuuaucaguggguauucuuauggugcg

SEQ ID NO: 4252498 - RNA, 63 nt, Streptococcus pyogenes M1 GAS
ugugccugugugauuuugcaagcuaauggcuccuauggcuugcaccguaucauauugguagca

SEQ ID NO: 4252499 - RNA, 59 nt, Streptococcus pyogenes M1 GAS
uugccguugguacuacagacaauaacagaugugauuauugcugagaauaucaaaagcaa

SEQ ID NO: 4252500 - RNA, 68 nt, Streptococcus pyogenes M1 GAS
agaggguuuagaugauaaaggccacggauuugaauuaggugcugaugauuaucugacaaagccguucu

SEQ ID NO: 4252501 - RNA, 64 nt, Streptococcus pyogenes M1 GAS
aauaaaaaaugauguuaacaguuuuugaggaaagucuucuaaacugcuagcaucguuuuuuguu

SEQ ID NO: 4252502 - RNA, 59 nt, Streptococcus pyogenes M1 GAS
uggauggggcuagugaauggaugauuuuuaugaaaauugucuuaccauuagcuguucca

SEQ ID NO: 4252503 - RNA, 103 nt, Streptococcus pyogenes M1 GAS
ucuuugaccuguggguguucuaaggcauagucgauagauguuuucaugaauccaaauuuauccccaacaucguaacgauugccuuuaaauucucgugcaaaga

SEQ ID NO: 4252504 - RNA, 65 nt, Streptococcus pyogenes M1 GAS
uccuaaaaagcaaaaaagcaucuggauaaucuuuuuugauguccagauacuguugcauuccagga

SEQ ID NO: 4252505 - RNA, 61 nt, Streptococcus pyogenes M1 GAS
uuuguuuuugcccuccugacaauccaaacauauccuuguuaaggagcucugcaaaagcaaa

SEQ ID NO: 4252506 - RNA, 96 nt, Streptococcus pyogenes M1 GAS
uaaagggacagccaaagguuugaaggaguuugcuuaacuaauuuuaaaagaggauuuagauaaguucuuucuuucacuuuuguagaaauuccuuug

SEQ ID NO: 4252507 - RNA, 84 nt, Streptococcus pyogenes M1 GAS
guuuguagugaguucauaaggguaguuagaaauaguuacaggacuaucccaauuuagcuugcccuuagaaacuucuuuguaaac

SEQ ID NO: 4252508 - RNA, 58 nt, Streptococcus pyogenes M1 GAS
gagccagauucugugaucgcugugcuaguagcugcagcagacgcucucaguucggcuc

SEQ ID NO: 4252509 - RNA, 57 nt, Streptococcus pyogenes M1 GAS
uaaaagacaaacaagcuuacucuuucuagaugcgagaguaugcuuguuugucuuuua

SEQ ID NO: 4252510 - RNA, 125 nt, Streptococcus pyogenes M1 GAS
ggugcuuucaaaaacuuacuauacgggucguuuuggcaagcaugagcucauuuugguacagucggguguuggaaaagugaugucugcuaugacaguugcgaucuugguugagcauuucaaagccc

SEQ ID NO: 4252511 - RNA, 73 nt, Streptococcus pyogenes M1 GAS
caaggagcuuuggcaaaauuaaaguaugaggaucagcagauaucaacacgugagauuguuaaaaaacuccuug

SEQ ID NO: 4252512 - RNA, 95 nt, Streptococcus pyogenes M1 GAS
gauaaguguuugaucaguccauaaaauagauucgaacacauugaacgaauuagugguucuccuugucuauuuuggcgccuggugccaacgauguc

SEQ ID NO: 4252513 - RNA, 67 nt, Streptococcus pyogenes M1 GAS
gugcuaaaacaguuguuuggaaugguccaaugggugucuuugaaaacccugacuuccaagcugguac

SEQ ID NO: 4252514 - RNA, 126 nt, Streptococcus pyogenes M1 GAS
uuguagucuggauucgaccagcuugggacguuugagguaguuacacuucguuguuuuuuacuaucgucaaaccguugcaaccugucucugaccuuuucuacugucguaucuccagauuuauaccaa

SEQ ID NO: 4252515 - RNA, 115 nt, Streptococcus pyogenes M1 GAS
cguuguggcacaauuacuuggagcuaucuuuggucaguugguagugguaaugguuuauaaaccuuacuuuaugaaaacugaaaauccaaaucauguuuuaggcucauucucaacg

SEQ ID NO: 4252516 - RNA, 73 nt, Streptococcus pyogenes M1 GAS
auaaagauagucgugaggauauauuuagacaguuuuugaaauaugaaacagauguaucuuacgacugguuuau

SEQ ID NO: 4252517 - RNA, 59 nt, Streptococcus pyogenes M1 GAS
gcaauagaaaaagauagauuugggcuauuaggcuaucaagguaauacuuuuucuguagc

SEQ ID NO: 4252518 - RNA, 56 nt, Streptococcus pyogenes M1 GAS
gcugagaaaaaauuggcuuauuuagaagaauuaggugugucacauuuuuuaucagc

SEQ ID NO: 4252519 - RNA, 77 nt, Streptococcus pyogenes M1 GAS
gcuuccagcuuuugcaaccaagcgggccgacuuuuagggcuuccuucguaggcucuacugcguugcagagcuguugc

SEQ ID NO: 4252520 - RNA, 117 nt, Streptococcus pyogenes M1 GAS
aucuugucagaugugauuccuguuaggccauugauaaagcucuguaagggaacaucuguguaaacauaggugucaaagcugucaacuucuuuaugguggucauauuugacugcugau

SEQ ID NO: 4252521 - RNA, 70 nt, Streptococcus pyogenes M1 GAS
ucagugacuauuuuagcgaucaaugcgacaccuucacgggcuguuuugacacuugguaaaaugacacugg

SEQ ID NO: 4252522 - RNA, 87 nt, Streptococcus pyogenes M1 GAS
gcaucgccuaaucauagcaaaaagacaaauuucugaagacaaaucuucacuagagguuugucuuuuuuaugguuuaaaaugggaugc

SEQ ID NO: 4252523 - RNA, 93 nt, Streptococcus pyogenes M1 GAS
auuguuccaaaguucugcaaaaugcgcagcagccauauccgcuucugauugacuagcuggguaggcuggcgucagauugagaaugguuccaau

SEQ ID NO: 4252524 - RNA, 74 nt, Streptococcus pyogenes M1 GAS
cagucuuuggaaaagacaucgucaaauucacuggauaaaagggaaaucacuuggggaugcucuuuggcaaacug

SEQ ID NO: 4252525 - RNA, 63 nt, Streptococcus pyogenes M1 GAS
gugaauggcaaagcucaucauccaguuagaaucuguaauagugaugaugccgccaguguucac

SEQ ID NO: 4252526 - RNA, 58 nt, Streptococcus pyogenes M1 GAS
gagucagaagcauuuguucaauuggcagaaaugccuguggcagaaaccuucucggcuc

SEQ ID NO: 4252527 - RNA, 66 nt, Streptococcus pyogenes M1 GAS
gcgagugcuguuaccguuauuucuaguaucggugggcguaugcuaugguaugguggcgguucucgc

SEQ ID NO: 4252528 - RNA, 58 nt, Streptococcus pyogenes M1 GAS
ggagccacugaccuuugaccacuuagaagaaauuucugggaaagguuuucagggcuuc

SEQ ID NO: 4252529 - RNA, 64 nt, Streptococcus pyogenes M1 GAS
gcuuugaugucaauggcuucaaagucacuaaccaguugcuuuaauucagccauggcucuuuggc

SEQ ID NO: 4252530 - RNA, 92 nt, Streptococcus pyogenes M1 GAS
gcuuucguacgaccaaauuuuacgguacggaguuuaaggacaaaaucaucaacaaauucuuggauuucugauucuguaaagguaccgcgagc

SEQ ID NO: 4252531 - RNA, 80 nt, Streptococcus pyogenes M1 GAS
gcaagaguuucaccugaaggcauaacaagugcaagugcuucaucguuguuagcugguuugccuucagcgauaacuuuagc

SEQ ID NO: 4252532 - RNA, 82 nt, Streptococcus pyogenes M1 GAS
uuggacagucuuauuguuaguuuugguuuuucaacuucuaauaagaauuugaaaaauuggaaucucgacuauaagcguucaa

SEQ ID NO: 4252533 - RNA, 93 nt, Streptococcus pyogenes M1 GAS
ucaauuuauguacgaauauuaaaagacaaacaagcauacucucgcaucuagaaagaguaagcuuguuugucuuuuagaguaauuagugauugg

SEQ ID NO: 4252534 - RNA, 55 nt, Streptococcus pyogenes M1 GAS
gguuuuggguaaguauccucacuuuggccaaacaaaggauaaagcucccaaaauc

SEQ ID NO: 4252535 - RNA, 71 nt, Streptococcus pyogenes M1 GAS
ugacucacgaugagauugcuaaauauaugggaaaaucaagaccuuauauuagcaauaccuuacgucuguua

SEQ ID NO: 4252536 - RNA, 71 nt, Streptococcus pyogenes M1 GAS
uuguuguagcugcaacuuacgacuuugcagguaaauaauacuuacugccaucguaaucgcuguuacaauga

SEQ ID NO: 4252537 - RNA, 124 nt, Streptococcus pyogenes M1 GAS
uuuuaggauauauuuuuaauucauccucaauuugaauagcauguaaaaaguauaccaucauuuguucgauaaugauauuuuuuuggugcuuuuucgugagggcucugauacuaauuuccuuuaa

SEQ ID NO: 4252538 - RNA, 61 nt, Streptococcus pyogenes M1 GAS
aaucaucguuucaaacccagacauggaagcaacucuaaaagcugccuuugaaaagaugauu

SEQ ID NO: 4252539 - RNA, 69 nt, Streptococcus pyogenes M1 GAS
gagcuggcuuaucagaugcuuuuugauaguaaaugauaucaucaaaguuaauaucugauaagucugcuc

SEQ ID NO: 4252540 - RNA, 55 nt, Streptococcus pyogenes M1 GAS
uugguaauuuaauaguugcaggugugcuagguuuuggagcuguuaucauugccaa

SEQ ID NO: 4252541 - RNA, 65 nt, Streptococcus pyogenes M1 GAS
augaauguugucuguuccuugguuuaaaucaauguugucuugagccacucgaacagccacgucau

SEQ ID NO: 4252542 - RNA, 76 nt, Streptococcus pyogenes M1 GAS
ccgauagagcuaagaauuuggaaaaaccuaaauuacuauaaacuguuuuucuauuaaaauuguuagcacuagcagg

SEQ ID NO: 4252543 - RNA, 68 nt, Streptococcus pyogenes M1 GAS
ucguaaacuucaggauuuaucgggcauugauccuauuacuauuccugcugaugauccgggaguuaugg

SEQ ID NO: 4252544 - RNA, 68 nt, Streptococcus pyogenes M1 GAS
gaaggugguguggcaggaauaaccuugauuuuacacgcgcauuuugggauuaauccugcuuacucuuc

SEQ ID NO: 4252545 - RNA, 59 nt, Streptococcus pyogenes M1 GAS
uuggauguucaaagcgaugaggauuuugguuuuaaaguugucaaaguucugaaaucuaa

SEQ ID NO: 4252546 - RNA, 56 nt, Streptococcus pyogenes M1 GAS
uuggagugauugcacugcuguuugcauuaacauuuggaacagucaagucgguccaa

SEQ ID NO: 4252547 - RNA, 76 nt, Streptococcus pyogenes M1 GAS
aucacugcuuauacuuuggugauccgcugauaguuugcuaucagauggacuuaacaccaaaguuccaucaguugau

SEQ ID NO: 4252548 - RNA, 82 nt, Streptococcus pyogenes M1 GAS
gauugcugacuuuauggauguugauguuauggauauugccaaagaagcccaugagcaaacagguuauaaggucacgcguauc

SEQ ID NO: 4252549 - RNA, 100 nt, Streptococcus pyogenes M1 GAS
gguuaacaccuuugauugcagggaugucaagugggcuuggaagguaugcgauaaccgcaucaagcaucaauugaacaccuuuguuuuugaaggcagaacc

SEQ ID NO: 4252550 - RNA, 64 nt, Streptococcus pyogenes M1 GAS
gcaaaauaaguggcugcuucuuuaaggcgauugagguguugcucaaggaaggcuauuuuuuugu

SEQ ID NO: 4252551 - RNA, 77 nt, Streptococcus pyogenes M1 GAS
gauugguauuaccccuuauuauugcuauaaauugauuccuaaucaguuugguuuaauaguauccgguaucauugguu

SEQ ID NO: 4252552 - RNA, 109 nt, Streptococcus pyogenes M1 GAS
uuuuuuacaguaccuuccuuugcaagcaagguuaucugaugcaaauggaaacaucauagucgauaaucaugcuuuuaauggaaguuuuuugccaacuacugauaaagaa

SEQ ID NO: 4252553 - RNA, 90 nt, Streptococcus pyogenes M1 GAS
gucucgaagaggacuucacuuauauuuuaaaagacggcauugugaaacagaguguucuuucaaaauauggaauggaauuuaauuugagau

SEQ ID NO: 4252554 - RNA, 86 nt, Streptococcus pyogenes M1 GAS
cgccaauagaaaucacaauauccggauuuuucuuugaaagauagaaaucaggaucaucuuuaaauacggagaaaaguuuggaggcg

SEQ ID NO: 4252555 - RNA, 67 nt, Streptococcus pyogenes M1 GAS
ggguaacaaaagacaguauuuuaguggaccacgauggucacuuacauccuauuucuuuugcggaccu

SEQ ID NO: 4252556 - RNA, 86 nt, Streptococcus pyogenes M1 GAS
aguuugucaagacagaaacaauagcauugcuccaaaaaaggcgcuuauagugcgauuguuuuuugucuuuuaauuuuugauaagcu

SEQ ID NO: 4252557 - RNA, 70 nt, Streptococcus pyogenes M1 GAS
agaggugucuugucaguuuugguuacaacaucaagugccaaaagacuuugcgacuuaacaagacacuucu

SEQ ID NO: 4252558 - RNA, 102 nt, Streptococcus pyogenes M1 GAS
uugucuauauugaugucguaaugagugguuuuagugaugguaagccccuaaaaaaugaggguaauccaucacaaagcuaaugguuacgauuuaauuugacaa

SEQ ID NO: 4252559 - RNA, 74 nt, Streptococcus pyogenes M1 GAS
uaauauguaacgcuuguuuaugaaagguaucuaagcuauagaaacuuuuuauaagcaggcguuuuguuguauua

SEQ ID NO: 4252560 - RNA, 60 nt, Streptococcus pyogenes M1 GAS
cguuugcugauaguacauugucaauauuuucgagcgaugugauaauggcuuuagcauuug

SEQ ID NO: 4252561 - RNA, 78 nt, Streptococcus pyogenes M1 GAS
acgacucugcgaaaaaagagaaauaccuccuagauacgagaguaucuuugucggauuuccuauuuuucauuaagucgu

SEQ ID NO: 4252562 - RNA, 56 nt, Streptococcus pyogenes M1 GAS
gaaagucccaccucgguuuauucaguugucaaugaacaaaucaaggcgagacuuuu

SEQ ID NO: 4252563 - RNA, 63 nt, Streptococcus pyogenes M1 GAS
uugugguacucaugucuucauaguugccauaaguggcuucugaaaacuugaugucuaucacag

SEQ ID NO: 4252564 - RNA, 71 nt, Streptococcus pyogenes M1 GAS
ucucaucauuauuagucaugaguuugauauguuagaaaaacuuugugacgcgugcuauaugauugaagaga

SEQ ID NO: 4252565 - RNA, 80 nt, Streptococcus pyogenes M1 GAS
uagccccucaaaaaaagaggccacacucauuuaaauuuaaaugaguguggccucuuuuuuugaggagacgcaagggguua

SEQ ID NO: 4252566 - RNA, 82 nt, Streptococcus pyogenes M1 GAS
augcguuuaaucgauuuaucaaucucgucaauagccuuuuuaaaguuguugcuggcagacugauaguucuuagcaaaggcau

SEQ ID NO: 4252567 - RNA, 72 nt, Streptococcus pyogenes M1 GAS
ugggcaaaucaggauuuuuaaacugcuugauuugggucugcaaaucagcuuuuaaaauaucuugauugacca

SEQ ID NO: 4252568 - RNA, 77 nt, Streptococcus pyogenes M1 GAS
uaucuucuuaccuuauguguuuuuauugucuuauacauuuuaggauuaaugguagcauuaagguuaaagaaaugaug

SEQ ID NO: 4252569 - RNA, 71 nt, Streptococcus pyogenes M1 GAS
ugguuuuggugucuuuuccgcaacaauaccuucaacauggauauuaacugcagaaauaggcacuucugcca

SEQ ID NO: 4252570 - RNA, 73 nt, Streptococcus pyogenes M1 GAS
guuggauugcuuguuuuugagcacgacggaaagcaacacguugcucaaguugacgagcaauguuuucaccaac

SEQ ID NO: 4252571 - RNA, 64 nt, Streptococcus pyogenes M1 GAS
agacaaaucauuucacaauccguugacauguuugucaaugagauuuuugaugaguuauaugucu

SEQ ID NO: 4252572 - RNA, 94 nt, Streptococcus pyogenes M1 GAS
uuaggauugaugauguuuuagaugacaaaaagaaagcugauuuauuggcuuacauuggaacuuauugucgugugaaacaacuccucaaaccuga

SEQ ID NO: 4252573 - RNA, 116 nt, Streptococcus pyogenes M1 GAS
agaggauaaacccaaugaaaauuugagaagcaaucaaaggcaggauaugaugccucacaauauaauaaggcguuuuucccaugcuuuuagagagcuggacaaaggcuuuauucuuu

SEQ ID NO: 4252574 - RNA, 94 nt, Streptococcus pyogenes M1 GAS
gauuaggauuauuuuucaagaaauccaaaugagaaaccuugguaucauugaccauuaacguuucuaauuugggugcuugaaguguugcuaaguc

SEQ ID NO: 4252575 - RNA, 100 nt, Streptococcus pyogenes M1 GAS
ggucugucccucaauugguuuagaucaccaagcuauuuugggcgagacuuacgcuaauauugccgcccaaaaagcugguguuuuagaagggggcgagacc

SEQ ID NO: 4252576 - RNA, 57 nt, Streptococcus pyogenes M1 GAS
gcuguuauucuuuuucuuggaaccuucuuaaccugguuuuuagaaaaagauaacagc

SEQ ID NO: 4252577 - RNA, 63 nt, Streptococcus pyogenes M1 GAS
gcauuaucaugaauugacagacuugucaacuaacuugacaagucuagucaauguucauguagc

SEQ ID NO: 4252578 - RNA, 63 nt, Streptococcus pyogenes M1 GAS
agacauguucgucugauauacuagaauuccccaauucaguauggaaagcagaugaacaugucu

SEQ ID NO: 4252579 - RNA, 61 nt, Streptococcus pyogenes M1 GAS
ugaccauggacuuuggguguuacuacaaucacuauguuagugauaugacgaggaccauuca

SEQ ID NO: 4252580 - RNA, 129 nt, Streptococcus pyogenes M1 GAS
uagggcaaacagauuauccguaucguuuucauaauaaauaaaagucucgccuugauuuguucauugacaacugaauaaaccgaggugggacuuucuuguuugucgagcaauuuagugagauacgccgug

SEQ ID NO: 4252581 - RNA, 110 nt, Streptococcus pyogenes M1 GAS
cgguauuggaguauggccguaauaucgucagcguagaggaggagcgauugcuagauggcaauuacaccucuaucuauccuuacguaagauauacgccacaaccaaaaccg

SEQ ID NO: 4252582 - RNA, 59 nt, Streptococcus pyogenes M1 GAS
ggucaaagcucaugaaaguuguagguuuuuuuguccugcaaucuucuaggguuuuggcc

SEQ ID NO: 4252583 - RNA, 64 nt, Streptococcus pyogenes M1 GAS
ugcuacuugcuuguugauuaacugaacagcuuuaccgacuucuuugauugaugaugcaaguaca

SEQ ID NO: 4252584 - RNA, 59 nt, Streptococcus pyogenes M1 GAS
gccucuaaaucuuugauagaaacugauaagcuaggcugacugacaaacaauuuagaggc

SEQ ID NO: 4252585 - RNA, 130 nt, Streptococcus pyogenes M1 GAS
uacaaagggaaaugacgcgauauggcaaaccaaguuuuugaagaauauuuucagcauuagcagucauuuuuucuaguucuugguaagauucuucugguuuagcaaauuuaaccauuucaacuuuguggaa

SEQ ID NO: 4252586 - RNA, 129 nt, Streptococcus pyogenes M1 GAS
aaucugguucuuuguagucuggauucgaccagcuugggacguuugagguaguuacacuucguuguuuuuuacuaucgucaaaccguugcaaccugucucugaccuuuucuacugucguaucuccagauu

SEQ ID NO: 4252587 - RNA, 65 nt, Streptococcus pyogenes M1 GAS
gaagaacaugaagcugcuagcguuacuguucaagaucgugucacuagugcagcuucaaguacuuc

SEQ ID NO: 4252588 - RNA, 130 nt, Streptococcus pyogenes M1 GAS
ucugucgaggaaguacuauauagugcuauggaagacuucuauauugauauuaugauuggcgcuggagauacuagucguaguauucauuuggaucugccuccauuuacauugauuggugcuacuacacgug

SEQ ID NO: 4252589 - RNA, 67 nt, Streptococcus pyogenes M1 GAS
gguugucaaccuucuuuguugacaagguuaaucuuuuugauuucuuguuuggaaaggaguggcaacc

SEQ ID NO: 4252590 - RNA, 66 nt, Streptococcus pyogenes M1 GAS
ucauccuucaaaacauuguuuagagugauauuuuugucuuuaauuccgauguguuguaagguauga

SEQ ID NO: 4252591 - RNA, 77 nt, Streptococcus pyogenes M1 GAS
gacuguccugauuguacggacuauaucaguugacuuuuauagucuagcugaaauagcagugcaaaacuaagacacuc

SEQ ID NO: 4252592 - RNA, 67 nt, Streptococcus pyogenes M1 GAS
gaugacuuauagaacauuuuuaucguaugagccuuuguucauacgauuuuuuugucuaaaagucguu

SEQ ID NO: 4252593 - RNA, 73 nt, Streptococcus pyogenes M1 GAS
uccucagauuuuuuaucgaauauagaaacgguuuuauuuuguucuucuaauuguucguuagcgaaguugagga

SEQ ID NO: 4252594 - RNA, 72 nt, Streptococcus pyogenes M1 GAS
ccucccaauuuuuucaagaugacuaacuugguauuuuuuccgaauuuuucauuaggaauaaauaauggaagg

SEQ ID NO: 4252595 - RNA, 130 nt, Streptococcus pyogenes M1 GAS
cgccaacagaacguaagagagugauggcaaugguguugguaucugguaagaucucauauucguugaggccauaguuaccaauagugacuccauuuucaccaucaaagagacucacaaagcauucuuggug

SEQ ID NO: 4252596 - RNA, 64 nt, Streptococcus pyogenes M1 GAS
cauagcuaauaucagcuauauaagugauagcuuuaggcucuuguacaucugguguuugcucaug

SEQ ID NO: 4252597 - RNA, 58 nt, Streptococcus pyogenes M1 GAS
uccugcuuuuauuauucacuacuauagccuuuauggugguuauucuguaggugcagga

SEQ ID NO: 4252598 - RNA, 55 nt, Streptococcus pyogenes M1 GAS
uguugcaggaguacuaugacgguaagaucaagacugagauagucaacuccgcaca

SEQ ID NO: 4252599 - RNA, 73 nt, Streptococcus pyogenes M1 GAS
acauugucguugaagcuaauggauugggcuacaugauuaauguugccaauccuuauagcuuuacagauagugu

SEQ ID NO: 4252600 - RNA, 101 nt, Streptococcus pyogenes M1 GAS
aguuaucucaggugauuggcuuauacacaugguacguguuaaggggguuuccuuuagaugaagcuuugccguuguaucauugucgcaucgcuauguuagcu

SEQ ID NO: 4252601 - RNA, 90 nt, Streptococcus pyogenes M1 GAS
uugaagcuaguauggauaucaaucuuagucaagauaaggcuggacguuuggauuauagugaaaguuugaugacacaugcuaugguuuuaa

SEQ ID NO: 4252602 - RNA, 68 nt, Streptococcus pyogenes M1 GAS
gccaucaacauaccucuuaaguagauuuugguucguuaccaugucuacuuaagaggugucuucaaagc

SEQ ID NO: 4252603 - RNA, 78 nt, Streptococcus pyogenes M1 GAS
uggugaugcgccaaacuuguuuuuuaccugguguggauacuuuuucugcauuauuugauaauuugaucguaucacgca

SEQ ID NO: 4252604 - RNA, 60 nt, Streptococcus pyogenes M1 GAS
ugacuggcgugcuauugaagcaggggcccaugcuuaugccucaagaaaugguagcuauca

SEQ ID NO: 4252605 - RNA, 55 nt, Streptococcus pyogenes M1 GAS
agagaagcuguucucuuuggagaaauucaaauacuucaaggaaggcuuguucuuu

SEQ ID NO: 4252606 - RNA, 86 nt, Streptococcus pyogenes M1 GAS
gucaagcacuguuaccaaguugucaacuuguucgucaaauguuuuaccaagagcacgaggugauacuugaguagucaaugagauac

SEQ ID NO: 4252607 - RNA, 77 nt, Streptococcus pyogenes M1 GAS
uucuaaggcaaugauguuuaaaaauuugccacuguguuuccccacgcgcucuggcaaauaagacauauucacuagaa

SEQ ID NO: 4252608 - RNA, 59 nt, Streptococcus pyogenes M1 GAS
uaagguuggugauugacuagcaauagcaugagcuaaagcuuuuugaucaucaauccuua

SEQ ID NO: 4252609 - RNA, 62 nt, Streptococcus pyogenes M1 GAS
auggaugguaaagagcauauugcuauugcaaguuuggcaccugauguuuuuuguguaucuau

SEQ ID NO: 4252610 - RNA, 117 nt, Streptococcus pyogenes M1 GAS
agugacucggauacuuugauaaucguuuuaguagugccagcuugcugacaaguagcgguuaagucugcuuguugauaagcugauacaucaauaaaauaaucgccuuuauuuaguccu

SEQ ID NO: 4252611 - RNA, 105 nt, Streptococcus pyogenes M1 GAS
cacgccaaagcggccgacucuugcaacgaaaugugauuuacacggccauuacucggucuaaaaguaaguuaauucuguugggagaauauacugccuuugaguaug

SEQ ID NO: 4252612 - RNA, 61 nt, Streptococcus pyogenes M1 GAS
cagucaaugguacaguuuauaaagaucuuauuucagauucuguaaaagauacuaauggcug

SEQ ID NO: 4252613 - RNA, 73 nt, Streptococcus pyogenes M1 GAS
auguaaauaacaggugucaagguuuccuuaucuucauugagguauucgacgaaaucuugaaccccauuuucau

SEQ ID NO: 4252614 - RNA, 63 nt, Streptococcus pyogenes M1 GAS
guucuauuauuaguggccuguggucguggugagguaacggcacaaucaucuagugguugggac

SEQ ID NO: 4252615 - RNA, 61 nt, Streptococcus pyogenes M1 GAS
aggaaaaaauaucgcagaaguccuugauaugacugucgaugaugccuugguauuuuucucu

SEQ ID NO: 4252616 - RNA, 63 nt, Streptococcus pyogenes M1 GAS
aaucuaauugcuucaucaucaaucggacuauuguagucuucuaggugaugaagcuuuuuuguu

SEQ ID NO: 4252617 - RNA, 73 nt, Streptococcus pyogenes M1 GAS
uguuugugccucuguuaguacucuagccauuaacuuuguuaauucucuugagguguuagcagauugccaagca

SEQ ID NO: 4252618 - RNA, 75 nt, Streptococcus pyogenes M1 GAS
ggucaagguaauaugcaacuuccuuaugucaguccuuuguauggugauuaugaggauuugccugaaauaacgacc

SEQ ID NO: 4252619 - RNA, 59 nt, Streptococcus pyogenes M1 GAS
gucuccagaugcuguuuuugccggaaaagaauauuuucaaguauuaauguauuuggaac

SEQ ID NO: 4252620 - RNA, 125 nt, Streptococcus pyogenes M1 GAS
acuccuggaacgguuguggauucagcuaagccagauagcgccaauaacuuuuugguagcuguugacuuugaugguugccguuauggauuggcuuauauggauguauccacaggugaauuuugcgu

SEQ ID NO: 4252621 - RNA, 106 nt, Streptococcus pyogenes M1 GAS
ucagacugucuuuuucuaaaaguaauugacaggcuaaaccuuguucucgacacaaaugauuuagauugucaauguauuuuaauagggucacuuuagacaaguuuga

SEQ ID NO: 4252622 - RNA, 129 nt, Streptococcus pyogenes M1 GAS
ugcuucauaccauggccuaucucgaagagcgauuugguuuugaggucacuuauuugccuugucaaaauggacaaauaaauuuaucugacuuaaaacaagccuugagagaugacaccauuuugguaagca

SEQ ID NO: 4252623 - RNA, 77 nt, Streptococcus pyogenes M1 GAS
aagguuacguccuaucuagugguauugaagucucgcuagcggcuaguuauuucccauuacuacuaggacuuauccuu

SEQ ID NO: 4252624 - RNA, 90 nt, Streptococcus pyogenes M1 GAS
uagaauuaauugaacaaaccaaugaaaaucguaggguggcuuugguugucgauaugagaagucguuuguuuuucaaggaaauuaauucua

SEQ ID NO: 4252625 - RNA, 85 nt, Streptococcus pyogenes M1 GAS
ccaaucguuagauuuuuuugauauguccccuuucacuagaugaguccaguaaaagggggcauaucguuuuuugucuaacuuuugg

SEQ ID NO: 4252626 - RNA, 97 nt, Streptococcus pyogenes M1 GAS
ucuuacaaguuaccuuaguauccuuguucuuaguguuaaccuguuuaacagggauuaugggauuaaugaugcuaagugguaaauuauugucacaaga

SEQ ID NO: 4252627 - RNA, 72 nt, Streptococcus pyogenes M1 GAS
guucaagaaagguugguaaaguuaucacgccguacgcaugaaaacuuucucuucauccuuuugugcccggac

SEQ ID NO: 4252628 - RNA, 116 nt, Streptococcus pyogenes M1 GAS
gcgccuaagaagcguuuaacaaaagcagaaguggaaaagcaacgugccauuaagaggaugauuuuaucuguuuuaauggcuuuguugcuuauuuuugcgaugcuucgcuugggcgu

SEQ ID NO: 4252629 - RNA, 83 nt, Streptococcus pyogenes M1 GAS
guuagcucaauuacaaaaggaacucgaucagcgcaauaaugauuuauuauuggcguaugaacgguuugaguauuugaguggac

SEQ ID NO: 4252630 - RNA, 59 nt, Streptococcus pyogenes M1 GAS
gcuauuuuugaguguuguuuucuugccacgguauggcuagaauaacucucaaaaaucgu

SEQ ID NO: 4252631 - RNA, 66 nt, Streptococcus pyogenes M1 GAS
gaucaucggaguguuaaugggauuaaagugauaccucuagcugaucauauugacaaucaaaugauu

SEQ ID NO: 4252632 - RNA, 94 nt, Streptococcus pyogenes M1 GAS
ggguucuugggugguuuuacaggacguuuuaucgaagaaaguuugagugcagaaggcguuaaaacugauuuuguaaaaggugaucaagauacuc

SEQ ID NO: 4252633 - RNA, 70 nt, Streptococcus pyogenes M1 GAS
uuaacaagccuaucacagugguguuuuacggagaucauuuacccgguuuauauccugauagugcuuuuaa

SEQ ID NO: 4252634 - RNA, 93 nt, Streptococcus pyogenes M1 GAS
cuuggcagaagaagacuagguauaacuggguaguacuaacgucauguuuacuuaauaaaguaaugcuugguuucuaaaauaacaacuggcgag

SEQ ID NO: 4252635 - RNA, 60 nt, Streptococcus pyogenes M1 GAS
guuuacuuaauugggcuguugacauagagacacaaucaauacagccccaagaaguguaac

SEQ ID NO: 4252636 - RNA, 60 nt, Streptococcus pyogenes M1 GAS
ugcaccuuugauggcaccaguaagcgcaaauugcucugaaaagucaucaacagauuugca

SEQ ID NO: 4252637 - RNA, 61 nt, Streptococcus pyogenes M1 GAS
uuguuacucuugauggaacagaauuacgaccaggugguucuuuuucaggaggagcuaauag

SEQ ID NO: 4252638 - RNA, 59 nt, Streptococcus pyogenes M1 GAS
augaauuuacaauugaucagaaaauggauauuguuuuuucuggucuaggauggauucgu

SEQ ID NO: 4252639 - RNA, 80 nt, Streptococcus pyogenes M1 GAS
gauucugauauucacuaauaacaucaaaaaaggguucaguuaaacugagccuuuuuugauauuauguggcgauuaagauu

SEQ ID NO: 4252640 - RNA, 102 nt, Streptococcus pyogenes M1 GAS
uacuuguuaaaggugauagaucaacagguuguccaucaauuguuacagauacaccuuuugucacaccaagugucaacaaugauucuguuauuucugcaggua

SEQ ID NO: 4252641 - RNA, 76 nt, Streptococcus pyogenes M1 GAS
guaaucggaugacaaguuccuuuugagauauggcaaagcaauaccucgaaucaggaauauggagcauuccggcaac

SEQ ID NO: 4252642 - RNA, 69 nt, Streptococcus pyogenes M1 GAS
gaguagaugauuuuuuauugagacacccuugauuggcguuucguuaaaagguaaagaaugauuuuacuu

SEQ ID NO: 4252643 - RNA, 127 nt, Streptococcus pyogenes M1 GAS
gauaacuguuugaugaaugcugcugguguuuacugcaugacaaaagaagagcuuauggagguugaaaagucucaagccgcuuccuuugucaccaaaacagggacgcuugaaguucguccagguaauc

SEQ ID NO: 4252644 - RNA, 90 nt, Streptococcus pyogenes M1 GAS
cauuacugcauuugacaugauuugauagccaguauuauuugggugaaaaugguccccaguaaacaaggcaucauugacaauuguaguuug

SEQ ID NO: 4252645 - RNA, 66 nt, Streptococcus pyogenes M1 GAS
uggacaugauuuguucuucguuuaaggaaauauucgcuucuuuaagcucuugaauagacuccgcca

SEQ ID NO: 4252646 - RNA, 65 nt, Streptococcus pyogenes M1 GAS
aucauauaagggagaugcuguccagacaucuuugaauuguuugguaauccagcauuccuuuugau

SEQ ID NO: 4252647 - RNA, 79 nt, Streptococcus pyogenes M1 GAS
gaaggauauuuugagagcuaucaagaauaguaaagggcgauucauuuccuuauuuuuccuaauggccuuaggcuccuuu

SEQ ID NO: 4252648 - RNA, 78 nt, Streptococcus pyogenes M1 GAS
ugaaggguauuaugagcaggccauuuuugaugccuauccuaaugaccuuaucaaggaggccuuucauuaugccuauca

SEQ ID NO: 4252649 - RNA, 122 nt, Streptococcus pyogenes M1 GAS
ccaaguaugcuaaaacucaagaagugauuaaauaaaacauuaaagaaccuugucauaucaacguuuguugaagauaucaagguuuuuucuuguguuuuggggcauuuuuggggcauauuugg

SEQ ID NO: 4252650 - RNA, 55 nt, Streptococcus pyogenes M1 GAS
gucaaaagcacagcaaucuuacuaggacagguccuaggauaguuaugcuuuugau

SEQ ID NO: 4252651 - RNA, 127 nt, Streptococcus pyogenes M1 GAS
aauaugguuaauuauaacaaaauauugaacauuaagcaagaaauuuguuauuuauaugucauaaaacauaacauguaaaugacauguuuuuuacgcuuauuggaggugauucuggcuuaucuauguu

SEQ ID NO: 4252652 - RNA, 55 nt, Streptococcus pyogenes M1 GAS
aauauuuucagaaaaagcagcacgugauuggcgcuaugcuuuuuuuaagaguauu

SEQ ID NO: 4252653 - RNA, 59 nt, Streptococcus pyogenes M1 GAS
gacgucagaagcuuugcgcuugguucaacagggccuacguaaaaaugcauuugacaguc

SEQ ID NO: 4252654 - RNA, 80 nt, Streptococcus pyogenes M1 GAS
gcugcagaagcaauggauguuccuaugauuuuugcgaaaaaacauaaaaacauuaccaugacagaaggcauuuugacagc

SEQ ID NO: 4252655 - RNA, 65 nt, Streptococcus pyogenes M1 GAS
gaaguuuucaucaaaggagcucccugauaagguggaaacaacuguuuaucauccuuuaaaacuuu

SEQ ID NO: 4252656 - RNA, 63 nt, Streptococcus pyogenes M1 GAS
cuguuugggaacauaaucguccauugauuucaaaauuaauggaaauggguguuucuguaacag

SEQ ID NO: 4252657 - RNA, 90 nt, Streptococcus pyogenes M1 GAS
uuuuuuugacagguuuugugcacuguaaaauaggcaagguacucguugccuagucugucauuauggguuuguagggcauugucaaaaaaa

SEQ ID NO: 4252658 - RNA, 75 nt, Streptococcus pyogenes M1 GAS
aguuggacaaauaauuauugaaaggauuuaguucuguauuggacaggacuaaguccuuuuaguuuugcuuuaauu

SEQ ID NO: 4252659 - RNA, 106 nt, Streptococcus pyogenes M1 GAS
uacugaccccaaaaaguuggacaaauaauuauugaaaggauuuaguucuguauuggacaggacuaaauccuuuuaguuuugcuuuaauucguuuguuguuguagua

SEQ ID NO: 4252660 - RNA, 77 nt, Streptococcus pyogenes M1 GAS
cagccauuuuacagguccuuuaggcgugcaaugcuuauuugcagucauugcuuugcuagggauuuauuuuacgguug

SEQ ID NO: 4252661 - RNA, 113 nt, Streptococcus pyogenes M1 GAS
ccaggucuuuuuagacuuaauugacaaguaccaauuaucuccagaauuagcuaaauggaauaauaaugucuggcaugguaugguugguauuuauaagauucaagaagaccugg

SEQ ID NO: 4252662 - RNA, 88 nt, Streptococcus pyogenes M1 GAS
acauuaagguaugggcuuacuucagggucauuguuaaucaauucagacaagcaaaggaucaagugaaugaugucuugcgcaauaaugu

SEQ ID NO: 4252663 - RNA, 68 nt, Streptococcus pyogenes M1 GAS
gcguaacauccuuaaagguuggugaucgugucucuauugcaugguucuuugaaggauguggucauugc

SEQ ID NO: 4252664 - RNA, 55 nt, Streptococcus pyogenes M1 GAS
aguuuagcuaguuuuucucaauacggcaugaccuugagacagaucuggcuugacu

SEQ ID NO: 4252665 - RNA, 112 nt, Streptococcus pyogenes M1 GAS
ucaguucaaucagcagacuauuuugcucaaggagcuauugauauucuuugucaauuaggaauucagcaauuagcauuugggacagagaaugugauugauuaucaaaaacuga

SEQ ID NO: 4252666 - RNA, 70 nt, Streptococcus pyogenes M1 GAS
uucaaaaauugcuaauaaucguccaaaaagauaggaacgauuuugauugguaugaucuagcaucggugaa

SEQ ID NO: 4252667 - RNA, 111 nt, Streptococcus pyogenes M1 GAS
gccuugauugguccaucugguuguggcaaaucaacuuaucuucguagucuuaaccgcaugaacgauaccauugauauugcucggguuacaggugagauucuuuaucagggc

SEQ ID NO: 4252668 - RNA, 75 nt, Streptococcus pyogenes M1 GAS
aagaacgauggcaaaauaggaaguuggcagaaaauccugauuuucuagacaacuuaucuuuuugaccaaguccuu

SEQ ID NO: 4252669 - RNA, 64 nt, Streptococcus pyogenes M1 GAS
agcaucaaauuaacaaagaaaagugcuuagcaauauaacuaagcacuuuuuuguuaauuggucu

SEQ ID NO: 4252670 - RNA, 61 nt, Streptococcus pyogenes M1 GAS
gcuaucuuuuggaaagccugccgugucuaaaaugccaaaguaggcauuuuuaggagaaggc

SEQ ID NO: 4252671 - RNA, 71 nt, Streptococcus pyogenes M1 GAS
uagcuauaggauuuaaugaauuaucuugaauguuacuuauaugaaaagaguucauuaggcauuaaaugcua

SEQ ID NO: 4252672 - RNA, 63 nt, Streptococcus pyogenes M1 GAS
uuuagcuugcucaggucuuugucacuuucucuccaagguauaaagacaggagcagcugcuaaa

SEQ ID NO: 4252673 - RNA, 78 nt, Streptococcus pyogenes M1 GAS
ccguauggccuucuuaugguauacucaagaauuugguuacaaagcugguucugaaauuacuaaagacaugucaggcgg

SEQ ID NO: 4252674 - RNA, 60 nt, Streptococcus pyogenes M1 GAS
acgguauucuugagcuuguucuaaguauucuucuggaauaucuucuucaagaauaucugu

SEQ ID NO: 4252675 - RNA, 113 nt, Streptococcus pyogenes M1 GAS
uuccacaagacuuucuuagugcuuucuuuacaacgaguucacaauuggaagcuuugauggaugagcuuaguagaggacggaucaauauugaggcagugucacguuugucggaa

SEQ ID NO: 4252676 - RNA, 62 nt, Streptococcus pyogenes M1 GAS
uucuagaugauagaugguugguugcaaaggaagucuaacagucauccauuuauuauuaggaa

SEQ ID NO: 4252677 - RNA, 80 nt, Streptococcus pyogenes M1 GAS
gauacacugucuucugcgcugcgaauuugcucuaguaagcucucaucuggugcaguguuguagcgagauuuuaggguguu

SEQ ID NO: 4252678 - RNA, 60 nt, Streptococcus pyogenes M1 GAS
gcaaaugauuauuuuuccuguaacggcugauucuguugcuaggucagguagucauccugc

SEQ ID NO: 4252679 - RNA, 80 nt, Streptococcus pyogenes M1 GAS
ucgauuaguuacucguuuuaaauggggauuaacagucaauaucacaccuccugauuuugaaacacgaguggcuauuuuga

SEQ ID NO: 4252680 - RNA, 84 nt, Streptococcus pyogenes M1 GAS
gccaauaguucgacggacuuauuucauauuuuguuugggaauauuuuagcugugcaagauagcgauaaguggauuacuauuggu

SEQ ID NO: 4252681 - RNA, 65 nt, Streptococcus pyogenes M1 GAS
ccugaugucauguguaauaaggaaauaaaauuuaaagcuuuccuugacuaugccaugacuuuagg

SEQ ID NO: 4252682 - RNA, 93 nt, Streptococcus pyogenes M1 GAS
caagaucgcucauucuuuuguuuaaaaugguaguaagcuccuaauauaccagcauuauuuccaugacuagcaaacuucagcugaguuuucuug

SEQ ID NO: 4252683 - RNA, 73 nt, Streptococcus pyogenes M1 GAS
uucauuugguguuagucccucauccauucugccagcuuuguggcuaagaaugugcaggaccaacgcuagugaa

SEQ ID NO: 4252684 - RNA, 82 nt, Streptococcus pyogenes M1 GAS
ugcuauuaguaagaccaauuaacaaaaaagugcuuaguuauauugcuaagcacuuuucuuuguuaauuugaugcuauuggca

SEQ ID NO: 4252685 - RNA, 66 nt, Streptococcus pyogenes M1 GAS
ucaaaggaaugcuccccuccgcuaucuucuaucugcccagauaucggaugacgauaauuucuuuga

SEQ ID NO: 4252686 - RNA, 67 nt, Streptococcus pyogenes M1 GAS
gagaugacaaaccuuaauccacuuaucgguuaacuguuuguuaacagugauuaaggauugucgccuc

SEQ ID NO: 4252687 - RNA, 68 nt, Streptococcus pyogenes M1 GAS
caugcaaaaauuaauggaagaaauucgcaaucgcaaggaugugauucucuuuauugaugaaauucaug

SEQ ID NO: 4252688 - RNA, 66 nt, Streptococcus pyogenes M1 GAS
gccgauuaccgguuaucucuaagcaucacguuuaacaaggaugauuuugagauaauuguguuaggc

SEQ ID NO: 4252689 - RNA, 71 nt, Streptococcus pyogenes M1 GAS
guaucugcaugguuaaggucaugaagcaggaauuacuggccuauuuuucauuuauccaaccaugggauuac

SEQ ID NO: 4252690 - RNA, 94 nt, Streptococcus pyogenes M1 GAS
uaugauaccaugacccguucgcuccgcaaguuuguaccuuugacugaaaauacagucaauauauacguuuguggaccgacggucuauaauuaua

SEQ ID NO: 4252691 - RNA, 59 nt, Streptococcus pyogenes M1 GAS
uugcuuuugauauucucagcaauaaucacaucuguuauugucuguaguaccaacggcaa

SEQ ID NO: 4252692 - RNA, 95 nt, Streptococcus pyogenes M1 GAS
gcuuuaaggaguuaaaaagucacgacaacgaaagauugaagauuaaguucuucagucuuuuuuaucguuaucugagcuugcuaccuugguaaagu

SEQ ID NO: 4252693 - RNA, 70 nt, Streptococcus pyogenes M1 GAS
uuuuaagauuacugguuaacaagagaagcuuggcuuuuuucaaccguucuuguaccagauaaucuugaaa

SEQ ID NO: 4252694 - RNA, 63 nt, Streptococcus pyogenes M1 GAS
ugauaaagacugagcauaaggagauaauaaacccauuuguccaauuuaucucggucuuugaca

SEQ ID NO: 4252695 - RNA, 57 nt, Streptococcus pyogenes M1 GAS
uucucaucugcuuuauggccguucucaacuaugggguggccugacacagauguagaa

SEQ ID NO: 4252696 - RNA, 92 nt, Streptococcus pyogenes M1 GAS
cgaaaacaggccuuguuugcuuugccuguuaaugaugaaauugaagaaguaaagucacuucauuugauaggacagagccaaaccucuuuucg

SEQ ID NO: 4252697 - RNA, 60 nt, Streptococcus pyogenes M1 GAS
cgugacuguauccccuugauaugguggguaaaaccaaccuaucacgccaguaaagucacg

SEQ ID NO: 4252698 - RNA, 56 nt, Streptococcus pyogenes M1 GAS
aaaagcucuauaaucucuugaauggguaaauccacuguagagauuauagagcuuuu

SEQ ID NO: 4252699 - RNA, 72 nt, Streptococcus pyogenes M1 GAS
gccauuaacaauauaguacauaggaccaccagaaauaugaccguuggcauccuuuguacgguauuuaaucgc

SEQ ID NO: 4252700 - RNA, 55 nt, Streptococcus pyogenes M1 GAS
uacuauuauggcagguguuaaucagaccaugauguuagcccuuuccaugguagua

SEQ ID NO: 4252701 - RNA, 105 nt, Streptococcus pyogenes M1 GAS
gcgguguccccuuaaaauggcuuuuccacagguuguggagaacccaaauuaacaguguuaauuuauuuuccacagguuguggaaaaacuaacuauuauccaucgu

SEQ ID NO: 4252702 - RNA, 62 nt, Streptococcus pyogenes M1 GAS
uuaaccuugcuacuggcacucuuugccaucgggguaacuaguagcgucagagcggaggauga

SEQ ID NO: 4252703 - RNA, 55 nt, Streptococcus pyogenes M1 GAS
aaaacauucuggaucugcggggcuauuuucaacucuugcagauuuagaaaguuuu

SEQ ID NO: 4252704 - RNA, 77 nt, Streptococcus pyogenes M1 GAS
ucaauguauucaaagcagucuaauugaaccuguuugauacuuuuuuugguugauuugucuaugcuuuaaauacuuga

SEQ ID NO: 4252705 - RNA, 95 nt, Streptococcus pyogenes M1 GAS
agcuaguuuuucuuaccuucaaaaacaagacgugacuauguaugugugugauagucagaauuuugauuuugaaaguauucagcuagaagcuaguu

SEQ ID NO: 4252706 - RNA, 68 nt, Streptococcus pyogenes M1 GAS
gcuuugaagacaccucuuaaguagacaugguaacgaaccaaaaucuacuuaagagguauguugauggc

SEQ ID NO: 4252707 - RNA, 81 nt, Streptococcus pyogenes M1 GAS
agaugacaucuuagcuuuuuugacucgugaguaaagcacugcgcuuagcgucucguuuaaagaagacaucagguaacgucu

SEQ ID NO: 4252708 - RNA, 60 nt, Streptococcus pyogenes M1 GAS
guugguuugguaguaugcaaaaauuugugaauaaagacucaucauggcuaccugaccaac

SEQ ID NO: 4252709 - RNA, 63 nt, Streptococcus pyogenes M1 GAS
uaaaaaacgguugaaccagauagacagauccuugaccagucuuuuggguucaaucauuuuuua

SEQ ID NO: 4252710 - RNA, 73 nt, Streptococcus pyogenes M1 GAS
auguaguguuguucagcuaggauuuccguuggaaccaucaaagccgauugaaaaccugcuguauaagcugcau

SEQ ID NO: 4252711 - RNA, 70 nt, Streptococcus pyogenes M1 GAS
caagaagcuaagcaugccuauauuuuagcaaccuauacggcaauguuagaauuccguagcuuacuugcug

SEQ ID NO: 4252712 - RNA, 82 nt, Streptococcus pyogenes M1 GAS
caagcuuaucuaguucuuuuuguaaagccucaagcuuaucaccuugauaagaggcucuugcaggaacaacauuguaggcuug

SEQ ID NO: 4252713 - RNA, 74 nt, Streptococcus pyogenes M1 GAS
ucaggcaaccaauauauuuuagagccgguuaauauuauuaauggcaaugguuacuauaauauguuuaagccuga

SEQ ID NO: 4252714 - RNA, 65 nt, Streptococcus pyogenes M1 GAS
auauuugauuuugcgauuagggaugugucaaaaagcauccucacacuaauggcgcaaucagauau

SEQ ID NO: 4252715 - RNA, 85 nt, Streptococcus pyogenes M1 GAS
guaauuuuaagucaaaguuagacaaagcacuguuaauaguccacaucacagugcuugcuaacuccugauuuuuaguuuugauugc

SEQ ID NO: 4252716 - RNA, 130 nt, Streptococcus pyogenes M1 GAS
ucguucuuuuuuuggcccagucgcugcuugggacaaagauaguggugcuauuuacaagguugagacugacuugaaaauggccaugauuaugcuggucuuaaaugcugcgaaaaagccaauuucuagccga

SEQ ID NO: 4252717 - RNA, 63 nt, Streptococcus pyogenes M1 GAS
gugaacacuggcggcaucaucacuauuacagauucuaacuggaugaugagcuuugccauucac

SEQ ID NO: 4252718 - RNA, 112 nt, Streptococcus pyogenes M1 GAS
uuuuuugauauagauuuuuuguugaaucuuuugguuuuuggaccugauauaaccagcauauuuugguuugucaucaucuaaaauaaagguuccaacagcuguuuuuaaagaa

SEQ ID NO: 4252719 - RNA, 76 nt, Streptococcus pyogenes M1 GAS
ggucucaucaucgugucuauaguucccaaagucuuguucaaauugcuggacgaguuggaagaucuauagacagacc

SEQ ID NO: 4252720 - RNA, 109 nt, Streptococcus pyogenes M1 GAS
uauggauuugcguuaucaccgagagcuuuuuaccaacuuaauccacagcagacagaaguuuuguauggugagguggugaaggccuuggauguagggagcaaagaucaua

SEQ ID NO: 4252721 - RNA, 56 nt, Streptococcus pyogenes M1 GAS
cauuaucaaagauaagcgauuuagacaaucguccgcagaugcuuguauugauggug

SEQ ID NO: 4252722 - RNA, 65 nt, Streptococcus pyogenes M1 GAS
gcguuuuucaggggaauuguucugauuggugacauccaacacuuuuuuuaguucccucaaaaugc

SEQ ID NO: 4252723 - RNA, 63 nt, Streptococcus pyogenes M1 GAS
gcuaacagcuaccaaagucuugucagauuucuuugaaacugcaguaagucuugguggcgaugc

SEQ ID NO: 4252724 - RNA, 68 nt, Streptococcus pyogenes M1 GAS
cuguuuuggugacaaaggaagcggcuugagacuuuucaaccuccauaagcucuucuuuugucaugcag

SEQ ID NO: 4252725 - RNA, 61 nt, Streptococcus pyogenes M1 GAS
aagaauguauccgauauacuuacgauaugaugucuagucgugagucaaaggacauguuuuu

SEQ ID NO: 4252726 - RNA, 63 nt, Streptococcus pyogenes M1 GAS
cugcgacagcaacuguuggucaaauacaagcuuuugcuucuaguacaacaguuguuucgucag

SEQ ID NO: 4252727 - RNA, 90 nt, Streptococcus pyogenes M1 GAS
cugaugcucaagauggugauuuagcagguuuagcuaucacagaugaugacauggcucgcaaagcuguuaacuauauuuuugaaacaccag

SEQ ID NO: 4252728 - RNA, 91 nt, Streptococcus pyogenes M1 GAS
gcugauuugguuaacucucgcuuugcucugcuauuugcucauuuuggagugacgguugauggcaggcaguuagcagaagguuaucaaaagc

SEQ ID NO: 4252729 - RNA, 92 nt, Streptococcus pyogenes M1 GAS
guuccgucuggucugucuauagaucuuccaacucguccagcaauuugaacaagacuuugggaacuauagacacgaugaugagacccaagaac

SEQ ID NO: 4252730 - RNA, 82 nt, Streptococcus pyogenes M1 GAS
cauuucaucaacuugcuuuuugauauugguagagaugccuuuaccuucguuaccaaugacuaaagcaaguuuaccauuagug

SEQ ID NO: 4252731 - RNA, 79 nt, Streptococcus pyogenes M1 GAS
uauguuaucaaaaagugaggcgacccuugaugcugaagaaauugagauguugcaaggaguuuucucacuugaugaaaug

SEQ ID NO: 4252732 - RNA, 65 nt, Streptococcus pyogenes M1 GAS
aguuagaguauaguugauauuggggauaagaaagugugauuucuaguccuaucugcuguuuaacu

SEQ ID NO: 4252733 - RNA, 102 nt, Streptococcus pyogenes M1 GAS
gagaagugaagaagccagagcauuuuugacacucagauggacauggcgaaugcgugugucuugagcuaguaaaaagugcuuggggauaucugucaacugcuc

SEQ ID NO: 4252734 - RNA, 80 nt, Streptococcus pyogenes M1 GAS
aucaaauuaaagggauacaacgcuauugugguucaacaugaaauugaccauaucaaugguguuuuguucuacgaucggau

SEQ ID NO: 4252735 - RNA, 92 nt, Streptococcus pyogenes M1 GAS
uucuuugauaccacgagcaagguauucaguguuuguaacgaagaagucgucaccaaccaauugaacacguuugccuaggcguucaguaagaa

SEQ ID NO: 4252736 - RNA, 130 nt, Streptococcus pyogenes M1 GAS
gaaagccaaacguucuaugcucgagacgcuaaaaauccuuaugauuuuaccguuacugcuuuaaaacacaaauagucugaggagaugauaagcgaugcaacguaguauuuuuggaguauuuacggcuuuu

SEQ ID NO: 4252737 - RNA, 75 nt, Streptococcus pyogenes M1 GAS
gcuuuagauggcgauaaugaaauuguccaagcuuuaaauauagggggagacgauuuuauugugaaaccauuuagc

SEQ ID NO: 4252738 - RNA, 86 nt, Streptococcus pyogenes M1 GAS
gcaauuugagagcgaaaucccgauuuaucagucuuuuagaguuuauagcgauuugaagaaacugauaaauugauuugguuucuugc

SEQ ID NO: 4252739 - RNA, 84 nt, Streptococcus pyogenes M1 GAS
cugauccaacuuugcugacaggagcugauauuaaaaaauauuuugauccucagaacuugcuuagcgaaaaacaaguagggcaag

SEQ ID NO: 4252740 - RNA, 57 nt, Streptococcus pyogenes M1 GAS
gcuuauaugggauuuggagugggugccggugguaccguuccuccuaauccuaucggc

SEQ ID NO: 4252741 - RNA, 57 nt, Streptococcus pyogenes M1 GAS
ucgaacauccugccuuucagcuaguugugcauacugaaaggcaauauucauguuuga

SEQ ID NO: 4252742 - RNA, 92 nt, Streptococcus pyogenes M1 GAS
ucuccaaaugugaaaaacacaccuaucuugcgacuacuucaaccuguaucaggaguccugucggaaauagguauguuuuuagcucuugcuga

SEQ ID NO: 4252743 - RNA, 57 nt, Streptococcus pyogenes M1 GAS
ccaccaagaaaaauacaguagccguuaucagugaugguacugcgguucuuggucugg

SEQ ID NO: 4252744 - RNA, 61 nt, Streptococcus pyogenes M1 GAS
cuuugaaaucaagguuuggcucuugccuugaacauaaugcaaguaagccaccuuggcaagg

SEQ ID NO: 4252745 - RNA, 67 nt, Streptococcus pyogenes M1 GAS
gucaggugagacauuuuuuuagaaagucgacuuaaauuaguauugauuucugaugucucaucuagau

SEQ ID NO: 4252746 - RNA, 65 nt, Streptococcus pyogenes MGAS315
gcugauugcagcacauagagggcacggcuuucauuggucgcaucauuugguacugcaauuugagc

SEQ ID NO: 4252747 - RNA, 78 nt, Streptococcus pyogenes MGAS315
gacauauuggcaauuugagcaaauuuuguuaaaucuucuccaccauuaauaacagcuguuucaauugcugauaauguu

SEQ ID NO: 4252748 - RNA, 62 nt, Streptococcus pyogenes MGAS315
ccuguauaagauccuauuugggaaugauccaucauaucagcacguaggacuugacuagcagg

SEQ ID NO: 4252749 - RNA, 66 nt, Streptococcus pyogenes MGAS315
uuccuuugaaaucaagguuuggcucuugccuugaacauaaugcaaguaagccaccuuggcaaggag

SEQ ID NO: 4252750 - RNA, 77 nt, Streptococcus pyogenes MGAS315
cagaccuugaaggaaucgguguccaaggcucaaacgguauuuccauuuacggcuugcacaugguaucaacugguuug

SEQ ID NO: 4252751 - RNA, 123 nt, Streptococcus pyogenes MGAS315
aaggcgccuucuauuuuggauuacuuagaugaggaaagucaggcgcacuuugaggcagucaaagcuaugcuugaagcacuugacauuccuuaugugauugacaccaauauggugcguggccuu

SEQ ID NO: 4252752 - RNA, 77 nt, Streptococcus pyogenes MGAS315; identical to SEQ ID NO: 4252591

SEQ ID NO: 4252753 - RNA, 62 nt, Streptococcus pyogenes MGAS315
guucaguuugucgaugauguggaagaagucuuagcucuauugcgucaacgacaagacaugac

SEQ ID NO: 4252754 - RNA, 90 nt, Streptococcus pyogenes MGAS315
cagaagcuaaauuguagucagcagcugugacgguuaauuuauagagccaagugaccagcaagucuguuguuccugccugauaguauucug

SEQ ID NO: 4252755 - RNA, 100 nt, Streptococcus pyogenes MGAS315
gaucaaucgccgcaaugaucccauuauuuugugcuacuaaacuuucugccagacuugucacagauuucauagacaaaguaggguuuugugcugauuguuc

SEQ ID NO: 4252756 - RNA, 123 nt, Streptococcus pyogenes MGAS315
cgauguggcugaauacuacuuacaaguugaggacuuugacuacccuaaacagguucuugaaaaccauuugcuagguuaggagguucucuauggguuuaguugauuuaagcuuaacagauuucg

SEQ ID NO: 4252757 - RNA, 74 nt, Streptococcus pyogenes MGAS315
gaaaaugcacaguauuaucagacuguugaaaaaucuaggggacagauugaaguuagagaauacugggugucuuc

SEQ ID NO: 4252758 - RNA, 56 nt, Streptococcus pyogenes MGAS315
agacuccuauaugggagauauuucugauccagaaguuauuuuagaguaugggguuu

SEQ ID NO: 4252759 - RNA, 60 nt, Streptococcus pyogenes MGAS315
gucaacgagguguugaccuuggccucuuugguugaaaaagaagguucaacagacgaugac

SEQ ID NO: 4252760 - RNA, 56 nt, Streptococcus pyogenes MGAS315
aaaagagugucuugaauucuuaaauauuaucucgguauuuagcaagauagucuuuu

SEQ ID NO: 4252761 - RNA, 57 nt, Streptococcus pyogenes MGAS315
acgauguggcuacuggaaagaugacacaaguaauggaauaguuaguagccaaguugu

SEQ ID NO: 4252762 - RNA, 115 nt, Streptococcus pyogenes MGAS315
aguaacaagaaaauaaaccgaaaacgcugugauuauuuaauaaguuuucuaguuuaaaaaaaacuagguuaauaagguuaaguuaauaagggcgcacgguggaugccuuggcacu

SEQ ID NO: 4252763 - RNA, 73 nt, Streptococcus pyogenes MGAS315
gcagaacuauaggcuaaaaaaggucugaugguauaaguauuaccaucagaccuuuuuuaguuggcagugaagc

SEQ ID NO: 4252764 - RNA, 56 nt, Streptococcus pyogenes MGAS315
uuaucaacuuuagagggaagaauaucaacaauagugacuucguuuugaagugauaa

SEQ ID NO: 4252765 - RNA, 63 nt, Streptococcus pyogenes MGAS315
gugugguaaggcaaggucaacaggaauauuaccugcauaggcuuguguuucuugccucaacac

SEQ ID NO: 4252766 - RNA, 66 nt, Streptococcus pyogenes MGAS315; identical to SEQ ID NO: 4252590

SEQ ID NO: 4252767 - RNA, 74 nt, Streptococcus pyogenes MGAS315
uuuagaugauuuguaugaguuaaguccuaaauuaaagauguuugguauucuaauuggugcagugauugucuggg

SEQ ID NO: 4252768 - RNA, 130 nt, Streptococcus pyogenes MGAS315
uguucuuuacggcaaagaagagcuuuugaaucaaguggagccucuugaauuuggcggagaaaugauugauuuuguuuacgaacaagaggccacuuggaaagaauugcccuggaaguuugaagcaggaaca

SEQ ID NO: 4252769 - RNA, 107 nt, Streptococcus pyogenes MGAS315
ggucuuuuuagacuuaauugacaaguaccaauuaucuccagaauuagcuaaauggaauaauaaugucuggcaugguaugguugguauuuauaagauucaagaagacc

SEQ ID NO: 4252770 - RNA, 82 nt, Streptococcus pyogenes MGAS315
aagagauaaaguauacacauguuucuggcuaugauuuguauaaauaugcagccacaccaagagacaaagaugcugauuucuu

SEQ ID NO: 4252771 - RNA, 61 nt, Streptococcus pyogenes MGAS315
gggaaaaaugaacuguugaaauuaguggaugaaaccacugccauuaaccuucauuuuaucc

SEQ ID NO: 4252772 - RNA, 57 nt, Streptococcus pyogenes MGAS315
cuuugaaaguuggucgaauugccgcucaagcuggcgaugagguuaauuuuacgcaag

SEQ ID NO: 4252773 - RNA, 77 nt, Streptococcus pyogenes MGAS315; identical to SEQ ID NO: 4252623

SEQ ID NO: 4252774 - RNA, 129 nt, Streptococcus pyogenes MGAS315
ugguuucuugaaaauguggcaagcgaugaauagugaucucauaauccguuacaauccaaacaagcuuguaaucgacuaaaagauuauuguuacuucguccuaauugcgcagacugucuaccagaaacca

SEQ ID NO: 4252775 - RNA, 59 nt, Streptococcus pyogenes MGAS315
aggaaugucaagugcuucaagcauagcuuugacugccucaaagugcgccugacuuuccu

SEQ ID NO: 4252776 - RNA, 77 nt, Streptococcus pyogenes MGAS315
guuugggugauccuuauccaguuucuucuguucaugguaucggaacaggggaugucuuggaugcgaucguugaaaac

SEQ ID NO: 4252777 - RNA, 80 nt, Streptococcus pyogenes MGAS315; identical to SEQ ID NO: 4252497

SEQ ID NO: 4252778 - RNA, 69 nt, Streptococcus pyogenes MGAS315
ggugauguggguaauaucguuuuacgagaccguaaagucuugucagaagaugguauuuucauuguugcu

SEQ ID NO: 4252779 - RNA, 130 nt, Streptococcus pyogenes MGAS315; identical to SEQ ID NO: 4252588

SEQ ID NO: 4252780 - RNA, 67 nt, Streptococcus pyogenes MGAS315
agcauguugacuuuguaacuauuuuaguggaugcacgcuugccacuuucuagucaaaaucccaugcu

SEQ ID NO: 4252781 - RNA, 59 nt, Streptococcus pyogenes MGAS315
aagguagcauugucuuugauaacguuucuaauaacaucaaagucuuuugugacuaccuu

SEQ ID NO: 4252782 - RNA, 60 nt, Streptococcus pyogenes MGAS315
uaacccuuauguccuugacauaaaagaccggcuuuugaugauccaucccauaaggggcua

SEQ ID NO: 4252783 - RNA, 66 nt, Streptococcus pyogenes MGAS315; identical to SEQ ID NO: 4252527

SEQ ID NO: 4252784 - RNA, 65 nt, Streptococcus pyogenes MGAS315
acucaccuaagaugauagugccugauuaagcuaacucgcuucauaggacacugucuuaggugagu

SEQ ID NO: 4252785 - RNA, 103 nt, Streptococcus pyogenes MGAS315; identical to SEQ ID NO: 4252503

SEQ ID NO: 4252786 - RNA, 75 nt, Streptococcus pyogenes MGAS315
acuucuguagaaaauuaggaaucugaccaugugugccuugcacacaagcgaagauugucuauuuuccuaggaagu

SEQ ID NO: 4252787 - RNA, 82 nt, Streptococcus pyogenes MGAS315
uugaucugguuguugucgauucaguagcagcuuuagugccacgugcugaaauugauggugauauuggcgauagccaugucgg

SEQ ID NO: 4252788 - RNA, 73 nt, Streptococcus pyogenes MGAS315
cgcaaagcagaguuagcgccauuuaugcguaucaaaacaacgcuagaugguccugcugauuaugcugaugacg

SEQ ID NO: 4252789 - RNA, 88 nt, Streptococcus pyogenes MGAS315
ggcagguggucaagguaauaugcaacuuccuuaugucaguccuuuguauggugauuaugaggauuugccugaaauaacgaccuuuguu

SEQ ID NO: 4252790 - RNA, 65 nt, Streptococcus pyogenes MGAS315
augugcuucauuugaagcaaucgcgcguccguuaccgguaaagcuauuuuuuccgauaagcacau

SEQ ID NO: 4252791 - RNA, 60 nt, Streptococcus pyogenes MGAS315; identical to SEQ ID NO: 4252697

SEQ ID NO: 4252792 - RNA, 110 nt, Streptococcus pyogenes MGAS315
ucaggguuaccucauaaugaauuggccgcacagauugcucgucaggcaacuguucuaaacucugaugauaacuuugcgguuguguuugcagcuauggguauuacuuuuga

SEQ ID NO: 4252793 - RNA, 72 nt, Streptococcus pyogenes MGAS315
uucuuaccaaugacuuaugugguaucugguuuacgacaaaccauuucauuaucaggucauauuggaguagaa

SEQ ID NO: 4252794 - RNA, 110 nt, Streptococcus pyogenes MGAS315
ccacauaagacuaugcaaggaacaguuaucacuuuaaccagcccuuuaacgggugaaguuaaagcguugucugaagcuguugauccugucuuugcacagggaguuauggg

SEQ ID NO: 4252795 - RNA, 101 nt, Streptococcus pyogenes MGAS315
ugccgauuaucgauuugaguuuucugaucaaacggucuuugucaccuuuccuaucccagaagaugccaagaacguuuaucaagacuugcaagcaaucggua

SEQ ID NO: 4252796 - RNA, 121 nt, Streptococcus pyogenes MGAS315
uagaucaagguuacuaaaugccuaaagaaguauaagauaacacacgaaagacagcaauacaaagcuuuagaguucugugucaucuuacugcuuugacagguuuuuagcuaaccuuuuucug

SEQ ID NO: 4252797 - RNA, 80 nt, Streptococcus pyogenes MGAS315; identical to SEQ ID NO: 4252654

SEQ ID NO: 4252798 - RNA, 65 nt, Streptococcus pyogenes MGAS315
gcuaauuuguccagcugauuggucaaacuaaccacuucuuuguccuucucagcuaauugauuggc

SEQ ID NO: 4252799 - RNA, 58 nt, Streptococcus pyogenes MGAS315
cggagugcaacuucuugacuuaaggacaaaaacagccaaaguuccugaagguauuccg

SEQ ID NO: 4252800 - RNA, 61 nt, Streptococcus pyogenes MGAS315
gauagccauucuaaggccauuucaaauauuuuuaugggaaauagcaccuagaaagguuguu

SEQ ID NO: 4252801 - RNA, 108 nt, Streptococcus pyogenes MGAS315
aacuguuuggcuuguuuaucguacuuccagcgauuacgauuauagucacgauacucugcugaucuaucaucguagucaacuguuguacgucuaccaccugcgaugguu

SEQ ID NO: 4252802 - RNA, 73 nt, Streptococcus pyogenes MGAS315
caaaucgaagaauguauccgauauacuuacgauaugaugucuagucgugagucaaaggacauguuuuuauuug

SEQ ID NO: 4252803 - RNA, 63 nt, Streptococcus pyogenes MGAS315; identical to SEQ ID NO: 4252578

SEQ ID NO: 4252804 - RNA, 66 nt, Streptococcus pyogenes MGAS315
cuuucaucacagcgauaguggaugcaugcgucuugucauaguccuccaugaguuguuuggugagag

SEQ ID NO: 4252805 - RNA, 75 nt, Streptococcus pyogenes MGAS315
auccguaagucuccagaugcuguuuuugcaggaaaagaauauuuucaaguauuaauguauuuggaacguauuggu

SEQ ID NO: 4252806 - RNA, 75 nt, Streptococcus pyogenes MGAS315
ccauggaaaccacauuaaagaaaugaucaagauagacgguauuaggaccauuuugauaauggguaaagggcaugg

SEQ ID NO: 4252807 - RNA, 73 nt, Streptococcus pyogenes MGAS315
gguaaugaagaacgucuugaccgucuuuauaaagaauugauuucaaaagacugguucaugaccuugauugacc

SEQ ID NO: 4252808 - RNA, 69 nt, Streptococcus pyogenes MGAS315; identical to SEQ ID NO: 4252539

SEQ ID NO: 4252809 - RNA, 84 nt, Streptococcus pyogenes MGAS315
uuuuugauggcgaugaagguuuauacgaagcagaaagugguauuuaugauuugauuuuguuagaccuuauguugccggagaaaa

SEQ ID NO: 4252810 - RNA, 79 nt, Streptococcus pyogenes MGAS315
cuggucguaucauggaaacuauuggacaaacggucgucguuuugaccauugauaauggcuuugcaaaaggcucggccag

SEQ ID NO: 4252811 - RNA, 56 nt, Streptococcus pyogenes MGAS315; identical to SEQ ID NO: 4252698

SEQ ID NO: 4252812 - RNA, 64 nt, Streptococcus pyogenes MGAS315
ucuuaaagagggucuacugucaagauuuauuuucguuuuucaacaguuucucucucauuuaaga

SEQ ID NO: 4252813 - RNA, 55 nt, Streptococcus pyogenes MGAS315
guuucaugguauggguugauauugcuugucguaaucucaauccgccuuaugaaac

SEQ ID NO: 4252814 - RNA, 100 nt, Streptococcus pyogenes MGAS315
gugacuagcaagggaugaguccauaagaauaauaaucuuuagaaaaaugguuuacuggaauggauuauucuuuauaagugagacuuaccgauuuagucau

SEQ ID NO: 4252815 - RNA, 100 nt, Streptococcus pyogenes MGAS315
ggucugucccucaauugguuuagaucaccaagcuauuuugggcgagacuuacgcugauauugccgcccaaaaagcugguguuuuagaagggggcgagacc

SEQ ID NO: 4252816 - RNA, 64 nt, Streptococcus pyogenes MGAS315
gagcauuuuugacacucagauggacauggccaaugcgugugucuugagcuaguaaaaagugcuu

SEQ ID NO: 4252817 - RNA, 77 nt, Streptococcus pyogenes MGAS315
gauuaucauugacaggaaaacuaguggauugaauaauauagauaucaucuccacgcacuguuucuucaauauugauc

SEQ ID NO: 4252818 - RNA, 97 nt, Streptococcus pyogenes MGAS315
ugcacgcauuguacguuggauugcuuguuuuugagcacgacggaaagcaacacguugcucaaguugacgagcaauauuuucaccaacaaggugagca

SEQ ID NO: 4252819 - RNA, 88 nt, Streptococcus pyogenes MGAS315
ggaagacuuggaagcagaaauguuugaguauauuauuucagaaauggaagcuaauggcuuugaacauuaugaaaucuccaauuuuacc

SEQ ID NO: 4252820 - RNA, 72 nt, Streptococcus pyogenes MGAS315
cuuggugguauuguagcugguugugccuuccuuauugaguuagaagguuuaaauggucgccaugcuauuagg

SEQ ID NO: 4252821 - RNA, 70 nt, Streptococcus pyogenes MGAS8232
uuuuuugaaagauuugggacaagaauuaaaaggucacucaucaaccucagguuccagauuguuuaaagag

SEQ ID NO: 4252822 - RNA, 67 nt, Streptococcus pyogenes MGAS8232
ugcagugaccauuauaaaaaaagcagugcaaaugacacugucuuuucuugagaugguauagaugaca

SEQ ID NO: 4252823 - RNA, 80 nt, Streptococcus pyogenes MGAS8232; identical to SEQ ID NO: 4252497

SEQ ID NO: 4252824 - RNA, 102 nt, Streptococcus pyogenes MGAS8232
aagcuaacacgucaggauuagcgucaaacaggcguagcgucaucaugauuaaaucaucaaagucaagugcuucgcuacgucguaauucuuccugauaagcuu

SEQ ID NO: 4252825 - RNA, 73 nt, Streptococcus pyogenes MGAS8232; identical to SEQ ID NO: 4252617

SEQ ID NO: 4252826 - RNA, 62 nt, Streptococcus pyogenes MGAS8232; identical to SEQ ID NO: 4252748

SEQ ID NO: 4252827 - RNA, 61 nt, Streptococcus pyogenes MGAS8232; identical to SEQ ID NO: 4252800

SEQ ID NO: 4252828 - RNA, 58 nt, Streptococcus pyogenes MGAS8232
gacguugaaguaagugacgacacgcguuuacguuaccguuacuuagauuuacgacguc

SEQ ID NO: 4252829 - RNA, 61 nt, Streptococcus pyogenes MGAS8232
ggacuggcugauaagguaaugcuguccaacuuuuuuuacagucacuuuuccagucaagucu

SEQ ID NO: 4252830 - RNA, 68 nt, Streptococcus pyogenes MGAS8232
gaguuuuaaucucaccaguuucuuuauugaccaaacggaaaguaacaaagauuggugcagaauaacuu

SEQ ID NO: 4252831 - RNA, 55 nt, Streptococcus pyogenes MGAS8232
uuaugcaucguuuugaugaagauagccgcaaaccuuuuaucaaacgcaugcauga

SEQ ID NO: 4252832 - RNA, 71 nt, Streptococcus pyogenes MGAS8232
aagaugcagcauuaucuuacuggaugacuugggagccaagcacuaauacaaagaugaaaauugcugaucuu

SEQ ID NO: 4252833 - RNA, 56 nt, Streptococcus pyogenes MGAS8232
gagcugugaaagcugcugcaucagcuacugcuaaaucagcaagcauuuuacgguuu

SEQ ID NO: 4252834 - RNA, 77 nt, Streptococcus pyogenes MGAS8232
cgaugguagcaguugcauuaacguaagcuucagcaagaguuucaccugaaggcauaacaagugcaagugcuucaucg

SEQ ID NO: 4252835 - RNA, 104 nt, Streptococcus pyogenes MGAS8232
ggcccagucgcugcuugggacaaagauaguggugcuauuuacaagguugagacugacuugaaaauggccaugauuaugcuggucuuaaaugcugcgaaaaagcc

SEQ ID NO: 4252836 - RNA, 55 nt, Streptococcus pyogenes MGAS8232
guuaggacguuuugggaaauuuuacgcguguagcaacuucccagagugccguaau

SEQ ID NO: 4252837 - RNA, 70 nt, Streptococcus pyogenes MGAS8232
acauaaacggauuuagcaaagucguaagugcguuuacgguaaagugcggcagcuaggucacggguaaugu

SEQ ID NO: 4252838 - RNA, 75 nt, Streptococcus pyogenes MGAS8232; identical to SEQ ID NO: 4252806

SEQ ID NO: 4252839 - RNA, 63 nt, Streptococcus pyogenes MGAS8232
cugccucuaaauuguuugucagucagccuagcuuaucaguuucuaucaaagauuuagaggcgg

SEQ ID NO: 4252840 - RNA, 93 nt, Streptococcus pyogenes MGAS8232
gacgguaaugcuaucggugauguggguaauaucguuuuacgagaccguaaagucuugucagaagaugguauuuucauuguugcuauuacuguu

SEQ ID NO: 4252841 - RNA, 58 nt, Streptococcus pyogenes MGAS8232
ugguguuauugacuugucugaagaagacaugcgucaacucacagacauuacugaccca

SEQ ID NO: 4252842 - RNA, 65 nt, Streptococcus pyogenes MGAS8232
gaauuuacugucucauaaucuugcucuagcugaggaagcaggaguagauucuuggacggcuguuc

SEQ ID NO: 4252843 - RNA, 74 nt, Streptococcus pyogenes MGAS8232
gaucguugacuuggaccaugacaauuuagucguuuccuugauggcuggaauuauugguggucuagguggcgguc

SEQ ID NO: 4252844 - RNA, 69 nt, Streptococcus pyogenes MGAS8232; identical to SEQ ID NO: 4252539

SEQ ID NO: 4252845 - RNA, 60 nt, Streptococcus pyogenes MGAS8232
ucuaaucauugugagucacgaccguuauuuuuuggauaagguggcaacagugaccuugga

SEQ ID NO: 4252846 - RNA, 72 nt, Streptococcus pyogenes MGAS8232
uuguuacacauaugggauauauuucgauaaaugauauggaaguggucaaaucucaugauggaaaaguaacaa

SEQ ID NO: 4252847 - RNA, 77 nt, Streptococcus pyogenes MGAS8232
uugaaaccguucgcgaaucagacgcuauccuucgugaagaaauugcuaaggcuggacuugaucgugacguguggcaa

SEQ ID NO: 4252848 - RNA, 63 nt, Streptococcus pyogenes MGAS8232; identical to SEQ ID NO: 4252578

SEQ ID NO: 4252849 - RNA, 75 nt, Streptococcus pyogenes MGAS8232
ucuugauaaggcaaaagcaacaggguuuguuauuccaacauggcaagaagccuugaaggcauuuuaccaacaagg

SEQ ID NO: 4252850 - RNA, 89 nt, Streptococcus pyogenes MGAS8232
gcuugaguuagcgucuuguacuucgcuuguaaaaguccaacauucuugccauugcuuuucaacgcugagucaagggcucuagccucugc

SEQ ID NO: 4252851 - RNA, 69 nt, Streptococcus pyogenes MGAS8232
gcgugguauaaaagcuccacaagcugcugguauuauccauucagauuuugaaagagguuuuauucgugc

SEQ ID NO: 4252852 - RNA, 81 nt, Streptococcus pyogenes MGAS8232
ucuuuauugauauagcgauuugucauuugcuaguaaugauuaaaacauuuagaaaaagacaagucauagaaucaucaagga

SEQ ID NO: 4252853 - RNA, 59 nt, Streptococcus pyogenes MGAS8232; identical to SEQ ID NO: 4252781

SEQ ID NO: 4252854 - RNA, 106 nt, Streptococcus pyogenes MGAS8232
aaaaauguagucuaaggcaauaaaaaaugauguuaacaguuuuugaggaaagucuucuaaacugcuagcaucguuuuuuguuaggugauuaggggaauauguuuuu

SEQ ID NO: 4252855 - RNA, 114 nt, Streptococcus pyogenes MGAS8232
aguaacaagaaaauaaaccgaaaacgcugugauuauuuaauaaguuuucuaguuuaaaaaaacuagguuaauaagguuaaguuaauaagggcgcacgguggaugccuuggcacu

SEQ ID NO: 4252856 - RNA, 58 nt, Streptococcus pyogenes MGAS8232
aauaguugcugcaugggcuccugaaggcgucgcugucauuguucguaaagcgauuauu

SEQ ID NO: 4252857 - RNA, 78 nt, Streptococcus pyogenes MGAS8232
gaucugguuguugucgauucaguagcagcuuuagugccacgugcugaaauugauggugauauuggcgauagccauguc

SEQ ID NO: 4252858 - RNA, 130 nt, Streptococcus pyogenes MGAS8232
aacuguaguuagugauuauggccaguuagcucaauuacaaaaggaacucgaucagcgcaauaaugauuuauuauuggcguaugaacgguuugaguauuugaguggacuagacauauaaguauacuauggu

SEQ ID NO: 4252859 - RNA, 69 nt, Streptococcus pyogenes MGAS8232
gcacaacaugaauaccauguucaucaauguauucuuuauugauuucuugaaugguauuuugauguuugc

SEQ ID NO: 4252860 - RNA, 81 nt, Streptococcus pyogenes MGAS8232
guuauggguauuuaagacuuguucuucagccauuauuucuccuuaagcugucucuaaaacggguuuugacuugccuucgac

SEQ ID NO: 4252861 - RNA, 79 nt, Streptococcus pyogenes MGAS8232
gugguucuaacuaccaagucccaguugaaguucguccagaacgucguacaacacuuggacuucguugguugguaaacgc

SEQ ID NO: 4252862 - RNA, 72 nt, Streptococcus pyogenes MGAS8232
uugccaucagccagaauauaauccuguaaaccaaucacauagguggauugcaauuuaguaaucuggcgguaa

SEQ ID NO: 4252863 - RNA, 84 nt, Streptococcus pyogenes MGAS8232; identical to SEQ ID NO: 4252809

SEQ ID NO: 4252864 - RNA, 64 nt, Streptococcus pyogenes MGAS8232
gagcauuuuugacacucagaugaauaugacuaaugcgugugucuugagcuaguaaaaagugcuu

SEQ ID NO: 4252865 - RNA, 70 nt, Streptococcus pyogenes MGAS8232
ugucuccuauuuagugauggauuuguuaaauggacagccaauuuacgaagcuaugcuagauaagauggca

SEQ ID NO: 4252866 - RNA, 58 nt, Streptococcus pyogenes MGAS8232; identical to SEQ ID NO: 4252799

SEQ ID NO: 4252867 - RNA, 83 nt, Streptococcus pyogenes MGAS8232
gagauguuagcauuagcuacugccaugagcucuguugguauugaagcagaagcugguggcacagcuaugacucaaacauuauc

SEQ ID NO: 4252868 - RNA, 103 nt, Streptococcus pyogenes MGAS8232; identical to SEQ ID NO: 4252503

SEQ ID NO: 4252869 - RNA, 89 nt, Streptococcus pyogenes MGAS8232
ggaucgcucauucuuuuguuuaaaaugguaguaagcuccuaauauaccagcauuauuuccaugacuagcaaacuucagcugaguuuucu

SEQ ID NO: 4252870 - RNA, 66 nt, Streptococcus pyogenes MGAS8232
gucuaggacuuuuaacuagcuuaggagcuauuguucgagcucaaggguauccuaagauuccuaugc

SEQ ID NO: 4252871 - RNA, 73 nt, Streptococcus pyogenes MGAS8232; identical to SEQ ID NO: 4252599

SEQ ID NO: 4252872 - RNA, 58 nt, Streptococcus pyogenes MGAS8232
auugugaccuuuuaaugaaauuuugaugguaauauugccauauugaguaggugacgau

SEQ ID NO: 4252873 - RNA, 60 nt, Streptococcus pyogenes MGAS8232
uuuuucaugagcuuugacaucucccuuuucacgcauggauugcuccaagcucuugaaaaa

SEQ ID NO: 4252874 - RNA, 77 nt, Streptococcus pyogenes MGAS8232; identical to SEQ ID NO: 4252623

SEQ ID NO: 4252875 - RNA, 74 nt, Streptococcus pyogenes MGAS8232
uuucaauuuuaaagagcaucuguuccaaauagucacguacuucugucacacugacaggugccuuuucuuugaag

SEQ ID NO: 4252876 - RNA, 57 nt, Streptococcus pyogenes MGAS8232
agcaauguaggaucuuugaaugaacauuuuguaauguuuccagagucuaacauugcu

SEQ ID NO: 4252877 - RNA, 76 nt, Streptococcus pyogenes MGAS8232
cuucaaaugucuaagagagauaguuauugcuuugugagauuuucaaaccagauacugcuuucucuugcauuugcag

SEQ ID NO: 4252878 - RNA, 61 nt, Streptococcus pyogenes MGAS8232
uaagagaaaagcuuuuaaccucguuucuccuaaacuuuagcaggguuaaacgauucucuua

SEQ ID NO: 4252879 - RNA, 78 nt, Streptococcus pyogenes MGAS8232; identical to SEQ ID NO: 4252747

SEQ ID NO: 4252880 - RNA, 66 nt, Streptococcus pyogenes MGAS8232; identical to SEQ ID NO: 4252527

SEQ ID NO: 4252881 - RNA, 77 nt, Streptococcus pyogenes MGAS8232
ugaauuggaagaagaaagacguuuagcuuaugucggaaucacaagagcugaagaaguucucuuuaugaccaaugcca

SEQ ID NO: 4252882 - RNA, 109 nt, Streptococcus pyogenes MGAS8232; identical to SEQ ID NO: 4252552

SEQ ID NO: 4252883 - RNA, 97 nt, Streptococcus pyogenes MGAS8232; identical to SEQ ID NO: 4252818

SEQ ID NO: 4252884 - RNA, 63 nt, Streptococcus pyogenes SSI-1
ucuacgauguggcuacuggaaagaugacacaaguaauggaauaguuaguagccaaguuguaga

SEQ ID NO: 4252885 - RNA, 65 nt, Streptococcus pyogenes SSI-1
gacuagaauguuccccuuugcgucagauaaccuugcuugcaaaggaagguauucuaaaaaauguc

SEQ ID NO: 4252886 - RNA, 63 nt, Streptococcus pyogenes SSI-1
aguaauauugugacauagaugucgaguuugguuaaaugcuucauaguuuggagcaauauuacu

SEQ ID NO: 4252887 - RNA, 83 nt, Streptococcus pyogenes SSI-1
gugaucaacgugauaaaaacaucaaaaaugcucuuaaaggccuacugccugaacgaguagcugauuuuuuaucagaagauuac

SEQ ID NO: 4252888 - RNA, 123 nt, Streptococcus pyogenes SSI-1; identical to SEQ ID NO: 4252751

SEQ ID NO: 4252889 - RNA, 100 nt, Streptococcus pyogenes SSI-1; identical to SEQ ID NO: 4252755

SEQ ID NO: 4252890 - RNA, 69 nt, Streptococcus pyogenes SSI-1
gguuuuggugucuuuuccgcaacaauaccuucaacauggauauuaacugcagaaauaggcacuucugcc

SEQ ID NO: 4252891 - RNA, 55 nt, Streptococcus pyogenes SSI-1
cggacauugcaucaggacaguucaugcugaaaugaaugcuuugauucaaugugcg

SEQ ID NO: 4252892 - RNA, 66 nt, Streptococcus pyogenes SSI-1; identical to SEQ ID NO: 4252590

SEQ ID NO: 4252893 - RNA, 68 nt, Streptococcus pyogenes SSI-1
caugcaaaaauuaauggaagaaauccgcaaucgcaaggaugugauucucuuuauugaugaaauucaug

SEQ ID NO: 4252894 - RNA, 60 nt, Streptococcus pyogenes SSI-1; identical to SEQ ID NO: 4252873

SEQ ID NO: 4252895 - RNA, 88 nt, Streptococcus pyogenes SSI-1
gacuuacuugaaaggucaaggagcuuacucugguaaugauuacaauaucauguaugugaccuugaacccaacugaaguucgggaaguc

SEQ ID NO: 4252896 - RNA, 62 nt, Streptococcus pyogenes SSI-1; identical to SEQ ID NO: 4252748

SEQ ID NO: 4252897 - RNA, 58 nt, Streptococcus pyogenes SSI-1
gaucagcucuuuggcauuaacugugacgugacgcaaauaaccacuaaagggcuguguc

SEQ ID NO: 4252898 - RNA, 58 nt, Streptococcus pyogenes SSI-1
uaugaaauaauucugcuggcccucgaagauuuuguagggcugaaacagguguuugaua

SEQ ID NO: 4252899 - RNA, 60 nt, Streptococcus pyogenes SSI-1
uaggacuuuuaacuagcuuaggagcuauuguucgagcucaaggguauccuaagauuccua

SEQ ID NO: 4252900 - RNA, 76 nt, Streptococcus pyogenes SSI-1
auuuuuguagcuaguagugagcucauccccucuuuuucaaguugacuggcgagcucgaagauugcuugacgaaaau

SEQ ID NO: 4252901 - RNA, 77 nt, Streptococcus pyogenes SSI-1; identical to SEQ ID NO: 4252847

SEQ ID NO: 4252902 - RNA, 82 nt, Streptococcus pyogenes SSI-1; identical to SEQ ID NO: 4252787

SEQ ID NO: 4252903 - RNA, 66 nt, Streptococcus pyogenes SSI-1; identical to SEQ ID NO: 4252804

SEQ ID NO: 4252904 - RNA, 77 nt, Streptococcus pyogenes SSI-1; identical to SEQ ID NO: 4252623

SEQ ID NO: 4252905 - RNA, 65 nt, Streptococcus pyogenes SSI-1; identical to SEQ ID NO: 4252842

SEQ ID NO: 4252906 - RNA, 63 nt, Streptococcus pyogenes SSI-1; identical to SEQ ID NO: 4252578

SEQ ID NO: 4252907 - RNA, 108 nt, Streptococcus pyogenes SSI-1
caucugccgauuaucgauuugaguuuucugaucaaacggucuuugucaccuuuccuaucccagaagaugccaagaacguuuaucaagacuugcaagcaaucgguaaug

SEQ ID NO: 4252908 - RNA, 80 nt, Streptococcus pyogenes SSI-1; identical to SEQ ID NO: 4252531

SEQ ID NO: 4252909 - RNA, 75 nt, Streptococcus pyogenes SSI-1; identical to SEQ ID NO: 4252786

SEQ ID NO: 4252910 - RNA, 105 nt, Streptococcus pyogenes SSI-1
gcgauggauagagcaggagacuucuuagcagguauccauauuggcuuaagggauauuauuaagccugguguggauaugugggaaguggaagcauauguucgucgc

SEQ ID NO: 4252911 - RNA, 85 nt, Streptococcus pyogenes SSI-1
ggcauaagacuaugacagaaaugcuuaaaggaauugcagccucagacggcguugcuguugcuaaagcauaucuacuaguucagcc

SEQ ID NO: 4252912 - RNA, 62 nt, Treponema pallidum subsp. pallidum str. Nichols
gagucauuggagcgaacggggcagguaagucaacuuuuuuaaaaguccuuuccggugaacuc

SEQ ID NO: 4252913 - RNA, 78 nt, Treponema pallidum subsp. pallidum str. Nichols
gcgcaagcauugcagugccagacugggugagcaccugauucuuaguguauucaaccauuugcuuugcgauguuugcgu

SEQ ID NO: 4252914 - RNA, 59 nt, Treponema pallidum subsp. pallidum str. Nichols
gcuuaucaauacaggaauugcaggugcucucgaugagcgcuuguguguuuuugaugugc

SEQ ID NO: 4252915 - RNA, 74 nt, Treponema pallidum subsp. pallidum str. Nichols
guguaugaguuugugggaaaugaaauagaaaaagguaggcaggcauauuuuauuuauccacguauucaugacau

SEQ ID NO: 4252916 - RNA, 94 nt, Treponema pallidum subsp. pallidum str. Nichols
cugcauggaaagcaauguggauuuucaagauguggggaaggguuuccugccuucgucgcaguucugaugaugccuuuuucguauucgauugcag

SEQ ID NO: 4252917 - RNA, 73 nt, Treponema pallidum subsp. pallidum str. Nichols
ucuucuuguucgauugcaaacucaugcucggcaaggucaagcugcuggugagaguuuucaagcgaaaagagga

SEQ ID NO: 4252918 - RNA, 80 nt, Treponema pallidum subsp. pallidum str. Nichols
guuauauuuucgcggacgaaauagaggaauuuuuucuguuuuugaaaaaacaugcugacuucgucggugauuuauuugac

SEQ ID NO: 4252919 - RNA, 86 nt, Treponema pallidum subsp. pallidum str. Nichols
gcacagggcuagcgccgaaagauauugucaaauguauccuuaaaugagggaugagccaggauaguaucuacgaccgauuccugugc

SEQ ID NO: 4252920 - RNA, 67 nt, Treponema pallidum subsp. pallidum str. Nichols
ugcagcuguauccgaaauaccauuuuucuuucgaaagcuuaggagugcuauuuugggagcagcagcg

SEQ ID NO: 4252921 - RNA, 79 nt, Treponema pallidum subsp. pallidum str. Nichols
ggucacuugaaaauaacacgaaaaaugucgcaggaauuguaauaagcaugacgauuuuuaucgcuguuaucaggagguc

SEQ ID NO: 4252922 - RNA, 75 nt, Treponema pallidum subsp. pallidum str. Nichols
ugcacacggugcugcaucgcgggcaggucuugaaccugaagauaaaauucuugcaguagcaggacgccgugugca

SEQ ID NO: 4252923 - RNA, 60 nt, Treponema pallidum subsp. pallidum str. Nichols
gucaugcuugucgacgagguacucaaaggccucuuugagguagccgacgacgaccgugau

SEQ ID NO: 4252924 - RNA, 95 nt, Treponema pallidum subsp. pallidum str. Nichols
ccugggguugccgaauaucggcgccgaucuguagugugcgcgguaggggugggaugccuguguacccuguuagucggcgcguuggguauagcagg

SEQ ID NO: 4252925 - RNA, 70 nt, Treponema pallidum subsp. pallidum str. Nichols
uacuccgacgcucguccguaacuucuuuuuuaaagagcaggaacuuacuggcgagugcaucgagacugua

SEQ ID NO: 4252926 - RNA, 59 nt, Treponema pallidum subsp. pallidum str. Nichols
ugagcgcugcgcgcaguugggugagcuuuugcgccgcacucaaccccguguagcgcuca

SEQ ID NO: 4252927 - RNA, 129 nt, Treponema pallidum subsp. pallidum str. Nichols
guccugugcagagcgacgggugagcagugcugcaagacgugcucgggccgcugcacgggcguugggaccugcuguaacggcgagaagccgugcugcaaggacugcgacuguaacugucccugccaggac

SEQ ID NO: 4252928 - RNA, 65 nt, Treponema pallidum subsp. pallidum str. Nichols
caccguugguggggcuggacguggcguuccgugcggaaaauggcuuccugcuccaacugacggug

SEQ ID NO: 4252929 - RNA, 100 nt, Treponema pallidum subsp. pallidum str. Nichols
gccugagacgcccgacauagagcuucucgggcgguucguucguuccguucaacgguaccuauacgaagacgccucacggaagcucauugucguuucaggc

SEQ ID NO: 4252930 - RNA, 70 nt, Treponema pallidum subsp. pallidum str. Nichols
uccugaagacgaucggcauauuguuacggagcagcaguuguuggcagaaguagaugugcugcuuucagga

SEQ ID NO: 4252931 - RNA, 71 nt, Treponema pallidum subsp. pallidum str. Nichols
ugagaagggacuugccccugaguucauugcggaaaagaccggcaagccacugggggagguccaacuucuca

SEQ ID NO: 4252932 - RNA, 59 nt, Treponema pallidum subsp. pallidum str. Nichols
uugagggucguuugacgcaacuugcucuagagagugagucugcgcgaaaggaucuugag

SEQ ID NO: 4252933 - RNA, 69 nt, Treponema pallidum subsp. pallidum str. Nichols
gagaaguggcaguuuggauuugaaccacacgggaagguugugugguaccgacaccggagugccaugcuu

SEQ ID NO: 4252934 - RNA, 77 nt, Treponema pallidum subsp. pallidum str. Nichols
cuagacuacggagauacaguuuuuacgucgguuuuugcacagaauacaagaacuaggagucugugucgcccguguag

SEQ ID NO: 4252935 - RNA, 57 nt, Treponema pallidum subsp. pallidum str. Nichols
gcgugaugcacgugauuuugugcugugguuuacccguaguaaauuugugcgucaugc

SEQ ID NO: 4252936 - RNA, 79 nt, Treponema pallidum subsp. pallidum str. Nichols
gcgcgcuuugaccgcggguauuuuuuacugaauuucucagggauugaagaguuuuacacaaaauacgcggacagugcgc

SEQ ID NO: 4252937 - RNA, 80 nt, Treponema pallidum subsp. pallidum str. Nichols
guuuuucccagcuuggcgcgcuugaguuguuucuuucuccuaagauugggaucacgaguguguaucaguuugggaguaac

SEQ ID NO: 4252938 - RNA, 55 nt, Treponema pallidum subsp. pallidum str. Nichols
gcugucugugugcugcacgaaaggcaaugcucucucgcgcauagcacgcaacggc

SEQ ID NO: 4252939 - RNA, 74 nt, Treponema pallidum subsp. pallidum str. Nichols
gcuuauaugcagaaguuuuuugugcagaugaagguaauucguuugcaguugauaaaaagguuuuagauguuggc

SEQ ID NO: 4252940 - RNA, 97 nt, Treponema pallidum subsp. pallidum str. Nichols
ucgauaccagagaagcgugcaucgauugcguacaaaucuaggagcaaacuguaggccuuuuuugauucgguuuuguacguuccucugaugguaucga

SEQ ID NO: 4252941 - RNA, 59 nt, Treponema pallidum subsp. pallidum str. Nichols
aacaagcaaucguuacucuuuuaaaaacgcugaaagggcgugggaaaacguugcuuguu

SEQ ID NO: 4252942 - RNA, 55 nt, Treponema pallidum subsp. pallidum str. Nichols
gcugucccggcaccugcagaaggauucccugagcuuucuggcgugcuuggacugc

SEQ ID NO: 4252943 - RNA, 72 nt, Treponema pallidum subsp. pallidum str. Nichols
acaucccuuuccagguaagugugugucgaacgcucagcgggcugacacgaacauguugcuugaaccagaugu

SEQ ID NO: 4252944 - RNA, 129 nt, Treponema pallidum subsp. pallidum str. Nichols
cagaauagacuugaccacacgguugccgguaucaaugucgcggcagagaacuugcaggcagcugagucucgcauccgcgacguggauauggcaaaagagaugguagacuacaccaagaaccagauucug

SEQ ID NO: 4252945 - RNA, 89 nt, Treponema pallidum subsp. pallidum str. Nichols
ugugguccaucuagcaguagggaaaacgacgauggacucugcgcagauuguagagaauguugacguguuucugucggagauggaucgca

SEQ ID NO: 4252946 - RNA, 86 nt, Treponema pallidum subsp. pallidum str. Nichols
gcguguauuauuuuaaugcagcgucuugcgcggaugagcguggucgcuucgaggaggcgcgugagcuguaucagaggagugcacgc

SEQ ID NO: 4252947 - RNA, 59 nt, Treponema pallidum subsp. pallidum str. Nichols
gauggugcgguuagaauaccugacccuggcguucucggggguguccuguuuguacuauc

SEQ ID NO: 4252948 - RNA, 80 nt, Treponema pallidum subsp. pallidum str. Nichols
ugagaccagcgacagaagacaagagcgcacuggccucccgggcacguuguguaaugucuucagccuuuugcgcaggaucg

SEQ ID NO: 4252949 - RNA, 78 nt, Yersinia pestis
gacugccuguagcgugaguggugcuaugaacgcuuuagcggcgugggucaucacuacacgcacaucugcaccuuuguc

SEQ ID NO: 4252950 - RNA, 57 nt, Yersinia pestis
uguugaccacuccacggcuuaugauuggcgguuaacguaagcugagucagucauaca

SEQ ID NO: 4252951 - RNA, 78 nt, Yersinia pestis
acuaaggauaauggaucuuguccugagugcgggucagcguuggugauucgcaguggggggcacgguccauuccuuggu

SEQ ID NO: 4252952 - RNA, 58 nt, Yersinia pestis
cccaauugagcaccguagcuuugcggugaacgccaaggcggagccgggcacaguuggg

SEQ ID NO: 4252953 - RNA, 62 nt, Yersinia pestis
ccaucaaggugcguacgucuuaauaguagauugaccugcuuaaguaaagaugacaucugugg

SEQ ID NO: 4252954 - RNA, 63 nt, Yersinia pestis
ccgccccggucaugcugauuauaccuaugagcaaaaauacgguguacgggauuaccguggugg

SEQ ID NO: 4252955 - RNA, 59 nt, Yersinia pestis
cuguaguaguaauauucgugguuaagggcgaccaacuuggccaugcucguuuuacauag

SEQ ID NO: 4252956 - RNA, 65 nt, Yersinia pestis
gcggauaaacgcgguauuaguggugaucaccgccgggauuauuacuggucuggccgcguugaugc

SEQ ID NO: 4252957 - RNA, 77 nt, Yersinia pestis
cuggccuucuugcaguuuagccagcaacugaucagcuuuuuguuguucguuauggucaugaagugcaaacaggcggg

SEQ ID NO: 4252958 - RNA, 58 nt, Yersinia pestis
agggcgccaaugacuuuuuagcccguauucaggaugcuggaaugccauuggugauccu

SEQ ID NO: 4252959 - RNA, 56 nt, Yersinia pestis
agcuaucgucgucgauuucaauguuuguauagcaaucauggaaugccaugauaguu

SEQ ID NO: 4252960 - RNA, 62 nt, Yersinia pestis
gcuggauaucuugcugugcaacgccauguucaucaaaccaggcacagcaaauauuaaccggc

SEQ ID NO: 4252961 - RNA, 55 nt, Yersinia pestis
uaucgcguuacuggcgggcgugacuaaaaugacagucagccgcuauuuacggaug

SEQ ID NO: 4252962 - RNA, 87 nt, Yersinia pestis
uucaucgaugaaacggcauuagggcauggcuggaacacccaaaacgguugguuacagcaaucucuguuggugcauuuucauaaugaa

SEQ ID NO: 4252963 - RNA, 61 nt, Yersinia pestis
gucgcuuuggucaacaucgggguuucgauauccaggaagccaugaucguccaugaagcggc

SEQ ID NO: 4252964 - RNA, 117 nt, Yersinia pestis
cguauugcgcuguuuguuaugcacucgucuaccuauuuugacaucauugaucaggcgauugcagccaagauuuaugaagaggcagguguuguaguguauggcggucagccugguacg

SEQ ID NO: 4252965 - RNA, 91 nt, Yersinia pestis
ccaaagaugcaggacagggauaccaauuuagcguucagaaucagaugacgauuaacgguaauuuugguguuucaugguccucgguuuaugg

SEQ ID NO: 4252966 - RNA, 69 nt, Yersinia pestis
gcgcuggaaaccaagcaacagcagacagagcagagccugacuuucuguuguguuggucguucacaaugc

SEQ ID NO: 4252967 - RNA, 65 nt, Yersinia pestis
uggcggaguguuucauccgugggaugcacagugcagggaugaaaaccacgggcaagcauuuucca

SEQ ID NO: 4252968 - RNA, 61 nt, Yersinia pestis
gucgauaaauugcucaauaaucgcauugcacucuucaaugucuuuauugaucgauucagac

SEQ ID NO: 4252969 - RNA, 101 nt, Yersinia pestis
ugaauaggguuagucuuugguagcugauagucuuuaguagcugauagucauugauaccguaggugcagccacuaucagcuaccacauuuagccucuguuca

SEQ ID NO: 4252970 - RNA, 78 nt, Yersinia pestis
ccgaugccuuucaggagaucgaugugcuggggcuaucacuggccugcaccaagcacaguuucuugguugagucauugg

SEQ ID NO: 4252971 - RNA, 130 nt, Yersinia pestis; identical to SEQ ID NO: 4227246

SEQ ID NO: 4252972 - RNA, 70 nt, Yersinia pestis
ggauuaucgccauuccguugauggacaugauugccaucauguaucgucguuuacgcaaaggcaugagucc

SEQ ID NO: 4252973 - RNA, 84 nt, Yersinia pestis
agaauggcaggccgugaaacagcgcuggcagcagcaaggcgucacaccgucugccgcgcugcucacgcuguuugccgccacccu

SEQ ID NO: 4252974 - RNA, 66 nt, Yersinia pestis
guuagguaacgguuccuucaaagucgauaacaauacccaguuggggcugaccuucaguuaccugau

SEQ ID NO: 4252975 - RNA, 61 nt, Yersinia pestis
gguuaaugcugaugcugauguuaauacugacucugguguugauuccgguauugcagcaacc

SEQ ID NO: 4252976 - RNA, 59 nt, Yersinia pestis
ugccaagcgcuuuggcaauuucagucccacguaaccagauuuguccagagugauuggca

SEQ ID NO: 4252977 - RNA, 128 nt, Yersinia pestis
guuuggugguuugguucuggugaucggguucgguuguuauggcuuuacggcucaccuggccuccgaugaaccaaccgccaauggggccauaagugcacugaaccccaaaacuuggacaucugcuuuac

SEQ ID NO: 4252978 - RNA, 59 nt, Yersinia pestis
ugucgaugaacugcguuuauaugccgaaaugcacgguauugaauucuuguugaucgaca

SEQ ID NO: 4252979 - RNA, 118 nt, Yersinia pestis
ccgcaauauucaguacgcauacaauauccuuuuacucagccgaugccgcacgcguuaugcacucuccgugcggcgauuuucuggugaacccuguauucugguaaaccuaauguuuugg

SEQ ID NO: 4252980 - RNA, 64 nt, Yersinia pestis
uuggugccugcuggcgcagagagugggucgguugaucaauucuuugaaaacggcgaggcauuaa

SEQ ID NO: 4252981 - RNA, 59 nt, Yersinia pestis
cuggguuaagcucgguagcgcaguaaauucgccaacugcugucaccgaccuucauccgg

SEQ ID NO: 4252982 - RNA, 55 nt, Yersinia pestis
ucaacaucguaccugaacgaucgccccccacacugcugaugggugcagauguuga

SEQ ID NO: 4252983 - RNA, 65 nt, Yersinia pestis
cugacaccagcaaacaaggcggucauuccccuugggugaaugugcuguugaaugcuggcaaucag

SEQ ID NO: 4252984 - RNA, 84 nt, Yersinia pestis
aaaaauccaagcacugcaacccgucaacuauguugcaauaauguugcaaugaauguuaaugguguugauuuuaaauugguuuuu

SEQ ID NO: 4252985 - RNA, 55 nt, Yersinia pestis
gcauucagcaacaagaggguaucaccgcccgugauauucgcucccaguuugaugc

SEQ ID NO: 4252986 - RNA, 105 nt, Yersinia pestis
gccgauaugcucaaagccuaucccgguuuaucagugaaucugguugccgguauuccugcaccggaucugauagcugauggccuggauguggugauccgcgucggu

SEQ ID NO: 4252987 - RNA, 58 nt, Yersinia pestis
agcuugaauaccugggauaauuccgcacgagcuggcggaaaucugugguauuuaggcu

SEQ ID NO: 4252988 - RNA, 63 nt, Yersinia pestis
gagccaagugaguuugugcagacauuccguuauagcgguaauggcgaaagcuccgcaggguuc

SEQ ID NO: 4252989 - RNA, 78 nt, Yersinia pestis
gggccguauuggcauggcguuagcccaacgggcacauuuugguuucaguaugcccgugcuguacaccagccgccgccc

SEQ ID NO: 4252990 - RNA, 63 nt, Yersinia pestis
gugggucagcaacuuuucccagaaccggcgacguucggucaucacgguaaaaugcugcuucac

SEQ ID NO: 4252991 - RNA, 59 nt, Yersinia pestis
gccauuuaugccgaucauccgugggcgaaccgcgaaagaguggagaugcaugaauuggc

SEQ ID NO: 4252992 - RNA, 58 nt, Yersinia pestis
cuggcccaggcgacgagugaccgagagguguuggauuuacauuuggcgcaagggccgg

SEQ ID NO: 4252993 - RNA, 55 nt, Yersinia pestis
auuguugcaggaagagggcugauuguugguuaucgugaucuucacugcgcacgau

SEQ ID NO: 4252994 - RNA, 64 nt, Yersinia pestis
gucccugucgggcugauuuguagcgguugcucugagaccaacugcuccuuuagccgugauugau

SEQ ID NO: 4252995 - RNA, 62 nt, Yersinia pestis
gcgcugaaaucuaugguggucguuggaaucauaaaggccaugcugccaucuauuuagccagc

SEQ ID NO: 4252996 - RNA, 68 nt, Yersinia pestis
guuaaugucacuuuaccagguucggcccgaccaauuuggcucuguaacugugucagggugauauuggc

SEQ ID NO: 4252997 - RNA, 83 nt, Yersinia pestis
gaugcauacccgucguacuuuaagcugcagaggugaacgaaagcaauuagcacauaugcagcuuggcgucugacggguauauc

SEQ ID NO: 4252998 - RNA, 55 nt, Yersinia pestis
gcuguagcugaggguuuguugauugccuaauggcaccgaaaaacucagauacagc

SEQ ID NO: 4252999 - RNA, 88 nt, Yersinia pestis
uuaccaccacgaguacggcugcggcgaucaccuucaacuuuggcgucguuuucaucuuccgcggcgcgugcauguugugaggugguga

SEQ ID NO: 4253000 - RNA, 82 nt, Yersinia pestis
aguggggcggugagucucaguucaucaacguaucagcgaaagccgguaucgguauugaugaauuguugaacgcuauccuucu

SEQ ID NO: 4253001 - RNA, 130 nt, Yersinia pestis
ugaucccagaaaaauaauuuggcguuacugccagguaaaacgaauggauuccgauaagcagacucaggaaaauaauuggggguaaugaaugccauuaauacuguggcagcgucaaauuagaaggggauua

SEQ ID NO: 4253002 - RNA, 58 nt, Yersinia pestis
guugcugcucaauuuuuugcacagaaacaccgguuucgauugcgguugagcuggcaac

SEQ ID NO: 4253003 - RNA, 110 nt, Yersinia pestis
aucuuuauuggucaccgcauucacaaaguucgucuguuguugcugguacuccucaacgacaugauuaauguuggcaauauuuuugcgguuaucaacugaccagcggagau

SEQ ID NO: 4253004 - RNA, 74 nt, Yersinia pestis
aauaagcauaaaagcuugugcggcuauuauaucgauauuccguauaucgguauuuaguuguauaaguguuuguu

SEQ ID NO: 4253005 - RNA, 106 nt, Yersinia pestis
ggucuucgcuuuaucgaccucuuuuuccagugccgccuuugccauuaaacacagggguugaguggcaucaaacaguuggaaauagaggcccgaaaggcgaccugcc

SEQ ID NO: 4253006 - RNA, 83 nt, Yersinia pestis
guugcuuuuaucgaaccgucggaucuugacaccaaaauggcguuuauccgccauaucgugaaagcauucgacauagaagcgau

SEQ ID NO: 4253007 - RNA, 65 nt, Yersinia pestis
gggcgauugauuuauuauucugaauaaaauuauccguaagauaaucaauaauaaggucaucgccc

SEQ ID NO: 4253008 - RNA, 56 nt, Yersinia pestis
ccgccuaugccacccguauugccgaagauuuccgcgaucguggucagcauguguug

SEQ ID NO: 4253009 - RNA, 75 nt, Yersinia pestis
ggcugauguuauuugucauuauuuaugagcgucuauacguuuagacgucuaaauagaaaaugacggaaguuggcu

SEQ ID NO: 4253010 - RNA, 88 nt, Yersinia pestis
ucauugacauuuauugccagauugaugugccaggggauaauaauuuauuacacaaucuggauaucaaguugucuauaaaacucaauga

SEQ ID NO: 4253011 - RNA, 120 nt, Yersinia pestis
ucugccuguucucucccguugcgggcucuuugucaauaaccucuaaucuccucuccggaggagauuucagacugcugacaacccucaaugacgcgaucugaaacggugaggauaggcaga

SEQ ID NO: 4253012 - RNA, 57 nt, Yersinia pestis
gugcaguaucgaucugagcuugaguaagauugaccucacgcucacugauuaacgcac

SEQ ID NO: 4253013 - RNA, 55 nt, Yersinia pestis
agcggacgauaauauccccugacauuacuuuauuaggggauuuauuuagccugcu

SEQ ID NO: 4253014 - RNA, 59 nt, Yersinia pestis
ggucgucgucauucacacccaauguaucgguuaacgaucagggucaggugacgauuacc

SEQ ID NO: 4253015 - RNA, 58 nt, Yersinia pestis
guuacaugguuuguugggcagcggacaagauuggcugcccguggcacaacuguguggc

SEQ ID NO: 4253016 - RNA, 82 nt, Yersinia pestis
ccaguaguaaccaauagcgcauuuaaaaauaaugaucagcaaucugcuuaugcauuaggugcgucuuugggccgcuauaugg

SEQ ID NO: 4253017 - RNA, 78 nt, Yersinia pestis
cugcgggagcgcuguuaucgccagccacuggugcugcaugcagauaauggugcggcgaugaagucgcagacccugcag

SEQ ID NO: 4253018 - RNA, 77 nt, Yersinia pestis
uguugguuaagguuagcgguguaguuaagguuagcuaugcaguuaagguuagcuaugcaguuaagguuagcuaugca

SEQ ID NO: 4253019 - RNA, 84 nt, Yersinia pestis
gcucacacugccgccagggcuguuuacacgcaagauaaccgcuuuaaucuuuggaucuaaacgggccuggcgaauuugugcugc

SEQ ID NO: 4253020 - RNA, 76 nt, Yersinia pestis
cguucauuuaucagugucauugccggugguuucgguacugaugguucuucuaccggcaaugcugaagaaaugggcg

SEQ ID NO: 4253021 - RNA, 59 nt, Yersinia pestis
gcccugauucugguaauccauaauuuuuuaaugagguuucuuuaccaugaaucagacgc

SEQ ID NO: 4253022 - RNA, 57 nt, Yersinia pestis
guggaucacuuuucauccgucguugacagcagugaaagcggugauggaugaucacac

SEQ ID NO: 4253023 - RNA, 67 nt, Yersinia pestis
aucagcuuuaugauugugugcgaucuuuucgauagcuuuuuuugaucucauauucccauggguugau

SEQ ID NO: 4253024 - RNA, 80 nt, Yersinia pestis
gcgguuauuauugacguuucuuuacguaaaguacgaaauccgagagggauuacgugcuuucuugaaagaaacgugacggc

SEQ ID NO: 4253025 - RNA, 62 nt, Yersinia pestis
uauucaacggaauagccacgaguaaauagcucacccagauauucgcggaacaccguugagua

SEQ ID NO: 4253026 - RNA, 79 nt, Yersinia pestis
gugauaaguacgccaucggcaccuuugaucgguaacuugcggguaccagaagcagaggugcccaguguugauggaucgc

SEQ ID NO: 4253027 - RNA, 63 nt, Yersinia pestis
acaucaaagagauaagcgguuaucaacaaauguucauggguuguagcuguuaucucgauuugu

SEQ ID NO: 4253028 - RNA, 65 nt, Yersinia pestis
ggagagaaacgcaguggagguuacguucgcuuaaauggcggcaacaauacacuggguuacuuuuc

SEQ ID NO: 4253029 - RNA, 91 nt, Yersinia pestis
ugguuaccgcuuuaccccgcugcaaacgaaucgcuggacccaauaaauuaccguuauagccccagguuugcgucgcaguggaagguaacca

SEQ ID NO: 4253030 - RNA, 67 nt, Yersinia pestis
ugauggcuaaugccauggucacaucguuaugauugcguggcgguggugacuguggcgcauggcugca

SEQ ID NO: 4253031 - RNA, 56 nt, Yersinia pestis
uaacggcucuguuucaguggguaaaugcauugcgcgcgcuaaagcaaacgccguua

SEQ ID NO: 4253032 - RNA, 71 nt, Yersinia pestis
ucacuuccaccgccugacugacgaugcuaucaaugucuuuuuguuguaucaggucagcagugaugaagugg

SEQ ID NO: 4253033 - RNA, 55 nt, Yersinia pestis
guagacgcuguuccugcugcuuggcuuucaagccaacggcggcaccggcgacuac

SEQ ID NO: 4253034 - RNA, 105 nt, Yersinia pestis
agugucauggcuaagcaaauuguuauugguguuucauuucaagaauuaaauaacgacuauuuuguuucgaugaaagaggcauuagaacaggcggccaaugauauu

SEQ ID NO: 4253035 - RNA, 56 nt, Yersinia pestis
uacccgugaaguaggaauaaaguuggugcucgauggcguguuuaaccacacgggug

SEQ ID NO: 4253036 - RNA, 79 nt, Yersinia pestis
ccgguguuuaaacgucuugauagcgaccagauugaguggaaagucagugauggguuucaggacguugaacugacacugg

SEQ ID NO: 4253037 - RNA, 96 nt, Yersinia pestis
gcucgauaaaauaccaagaucaucuaugcccucacaucugcaacuugaaucugcaacuugaaguaugggggguauaucagggaaauucuauggagc

SEQ ID NO: 4253038 - RNA, 84 nt, Yersinia pestis
ggcugcuacgcuccagauaagugagcaacccccuauuaucaucaagcuguguaaugaguugcucacauugcugccagcaaagcc

SEQ ID NO: 4253039 - RNA, 69 nt, Yersinia pestis
ucggaguuccuggccaauaugucccaugagcugcguacaccacucaauggggugauugguuuuacccga

SEQ ID NO: 4253040 - RNA, 59 nt, Yersinia pestis
ugccugucguuccgguacaugauucugaacacugugaaguguccgaggcggacauggua

SEQ ID NO: 4253041 - RNA, 55 nt, Yersinia pestis
uagcccgcgaagagauuuuaggcgucacauugccugaacaauuuuuguggcgcug

SEQ ID NO: 4253042 - RNA, 68 nt, Yersinia pestis
gcugggauuagccauuauauucagcgccauguugguuaaugcggugggugugauugguuuuaucgggc

SEQ ID NO: 4253043 - RNA, 77 nt, Yersinia pestis
gugaaucauauuggauugucagcaacgaaaaaaggccccguagggccuuucagacugcugacaaaccccgaugacgc

SEQ ID NO: 4253044 - RNA, 58 nt, Yersinia pestis
gcagcauacaacuuccgcaucacugacuggagccaguucaucgggauuugugcgcugc

SEQ ID NO: 4253045 - RNA, 67 nt, Yersinia pestis
cgcuucgccagaucguucaggaagcccaauaccugcuguggguuuucugccauuuugguggccagcg

SEQ ID NO: 4253046 - RNA, 57 nt, Yersinia pestis
ccaguagacggucauagaguugugcugcaaguguaucgacgguuaaaccgcuacugg

SEQ ID NO: 4253047 - RNA, 57 nt, Yersinia pestis
cuguaagucgauguugcucacguauccgguaacagccugcuguaacaugacuuauag

SEQ ID NO: 4253048 - RNA, 67 nt, Yersinia pestis
gggauacuccugccggcugacagguuuguuaacucucauauuaaccucaguaaagggaggagauccc

SEQ ID NO: 4253049 - RNA, 58 nt, Yersinia pestis
auaaccugauuuaucagccuaccuugcaagaagaggauuugggcaauaaagagguugu

SEQ ID NO: 4253050 - RNA, 94 nt, Yersinia pestis
ucauaggugcuuauggugaagguaacccggcggucgcuuauggcuguguucugggaacgcugguugccacacuuaccggguugagcauccguga

SEQ ID NO: 4253051 - RNA, 90 nt, Yersinia pestis
uguugccugauaugagugguauugauguauuacggcaagugcguaaaaaaagccguuugccgaucauuauguuaacggcuaaaggcgaca

SEQ ID NO: 4253052 - RNA, 57 nt, Yersinia pestis
ugacuaaucgacggcugccucaugguugcuauccuagaggagucuuuucuuuaguca

SEQ ID NO: 4253053 - RNA, 118 nt, Yersinia pestis
gauguugaagucuaugccuggaugccgguauuggcguuugauauggacccgucuuuaccucggaucacgcguauugacccuaaaaccgguaaaacgaguaucgacccagaucaauauc

SEQ ID NO: 4253054 - RNA, 112 nt, Yersinia pestis
augauuucguuauuugcugugguuauaaaggcuaugucauuaaagaauauuuugcgaauuacuuuaugcacaugucggauauuaccuucugcaugcgugauaaugaaaugau

SEQ ID NO: 4253055 - RNA, 59 nt, Yersinia pestis
cuggcuauggacugugcggcuucugaguucuacaaagacggcaaauauguucuggcugg

SEQ ID NO: 4253056 - RNA, 65 nt, Yersinia pestis
uauucgggugauugcugccgguagcggguguagcgaugauuuauuauuggagcauuuacccagua

SEQ ID NO: 4253057 - RNA, 65 nt, Yersinia pestis
gguacgcggcacuuagguugagguuagccguuuucagaucgguuuggccgccuaacaugccugcc

SEQ ID NO: 4253058 - RNA, 81 nt, Yersinia pestis
gagaccgguauauugcuugcaggugcugcggguaacgaugucguuggcccauuggcaguugaaguaauauucccuguacuc

SEQ ID NO: 4253059 - RNA, 59 nt, Yersinia pestis
ggaauugaacucaucaaucauugcacaaacccguuugaccaaugcagaagaguucagcc

SEQ ID NO: 4253060 - RNA, 66 nt, Yersinia pestis
gugcgguuuuauuugcccacuauccaauaacgguagagcggguggcuggucacagugagaucgcac

SEQ ID NO: 4253061 - RNA, 128 nt, Yersinia pestis
ucugcuacgacuacuuuuuuaucgguggcacgaacgaaggugauaguaacgaaggugauaguagcgaaauugccuuuucaguuuuuauuauuuuauugcuuccguuguucucaagcaguauccgcaga

SEQ ID NO: 4253062 - RNA, 83 nt, Yersinia pestis
acugguuuuaaaauugauaagccaccagaugaaaugaccacgauagagguucacaucacgcagguggcuuauuuaauaucagu

SEQ ID NO: 4253063 - RNA, 92 nt, Yersinia pestis
aagacgagcauggccguuugcguguuggugccgcuguuggugccggugcuggcaaugaagagcguaucgacgcgcuggucgccgcugguguu

SEQ ID NO: 4253064 - RNA, 62 nt, Yersinia pestis
gucuauuccuucucaguucaggucaaaccaacuguuuacguugauuagacggagggauggau

SEQ ID NO: 4253065 - RNA, 67 nt, Yersinia pestis
guugugcgagaugauuacagugccuccauaacugugguucggcaacguuuaucucguuaaaagcaac

SEQ ID NO: 4253066 - RNA, 68 nt, Yersinia pestis
gccgaaacccuguccgguggcgaagcacagcguauccgucuggcuagccagauuggcgcggguuuggu

SEQ ID NO: 4253067 - RNA, 80 nt, Yersinia pestis
gguacugauaucauguggcgguguucaugcucacccuagccuaaugucuugcagaucauacaccgcuaagguaucaaacc

SEQ ID NO: 4253068 - RNA, 65 nt, Yersinia pestis
aacuggcauugcuauugguggucgucaccuuaucgaugaugacuacgccguugcugaugcagguu

SEQ ID NO: 4253069 - RNA, 61 nt, Yersinia pestis
uucgggauagggaaaaguuaacguugucggguuaacuuuuucuaucccuauuuuuuccgaa

SEQ ID NO: 4253070 - RNA, 67 nt, Yersinia pestis
acgagcaucaauuucuggcaacguuaucacuucggcaccgaccucgcuugccagagauugcgcacgu

SEQ ID NO: 4253071 - RNA, 72 nt, Yersinia pestis
guagucuuccucgcuguguugcugauuaucccuuuucuccggaucccaagcugacagggugaguaagaacac

SEQ ID NO: 4253072 - RNA, 81 nt, Yersinia pestis
agggggccauaagugcacugaaccccagaucuuggaucuuuuuauccaugaucuggagguucgguucaaugaaacacccuu

SEQ ID NO: 4253073 - RNA, 77 nt, Yersinia pestis
cauugugcacaauaaacuguguuuugccggcaggaaccgucagugccauuggcucacauuguuuaucauugacagug

SEQ ID NO: 4253074 - RNA, 65 nt, Yersinia pestis
agacauauagagcagguuaucgaugccguucauguucuguucgauaaccugcgucacuguauucu

SEQ ID NO: 4253075 - RNA, 83 nt, Yersinia pestis
ccugcacaagcagggaaugaguagccgggcgauugccagagaacuggggaucucccgcaauaccguuaaacguuauuugcagg

SEQ ID NO: 4253076 - RNA, 125 nt, Yersinia pestis
acccgcgucaguugcuguucaaaguacagcuaccgcuggcgaugccaaccauuauggcuggggugaaccaaacguugaugcuggcauuguccauggugguuaucgcuucaaugauugcagugggu

SEQ ID NO: 4253077 - RNA, 83 nt, Yersinia pestis
uauguggaugcccuuaagcaucgucuccaguuugaugaagccgaagcaaucaucggaaggaugagacgaauagcauccauaua

SEQ ID NO: 4253078 - RNA, 66 nt, Yersinia pestis
auuucaucacugagcuggugggcaaaauccucgucgcugauuucaccacgcucauguugcugaaau

SEQ ID NO: 4253079 - RNA, 79 nt, Yersinia pestis
guacaaagcggagaagguuaacccgcuggguggcugcuuaccgcugaucauucagaugccaaucuucuuggcguuguac

SEQ ID NO: 4253080 - RNA, 62 nt, Yersinia pestis
cauuaacuauauguugauuuuucguuucauaaaugagaccagagguuaaauauauguuaaug

SEQ ID NO: 4253081 - RNA, 71 nt, Yersinia pestis
gggugauuucggggcagucgaggaucaaguuggaaacuuguaccagcaagcggcuuagcccuggaauaucc

SEQ ID NO: 4253082 - RNA, 77 nt, Yersinia pestis
uucacaaguaacagcgcugcccauuggugacuccccugguguuggauuacgcaguggccagcagcuguuaccgugaa

SEQ ID NO: 4253083 - RNA, 71 nt, Yersinia pestis
ucuuauugaauugagaagacucaaaggggcgcauuuggcgucccuucguucaucuucucgauguuuuggga

SEQ ID NO: 4253084 - RNA, 75 nt, Yersinia pestis
gacauuuuuucgcgggcauauuuuuagucuauuggguacaucguagucuauaaaaugccgcugugauuaagcguu

SEQ ID NO: 4253085 - RNA, 95 nt, Yersinia pestis
cccacugccguuaaagucaccccgcuaagccguuaugguuuuguccagacugaagucacauugccgguaacgcguuaagguuauuuugauguggg

SEQ ID NO: 4253086 - RNA, 86 nt, Yersinia pestis
auaguccuuccaugacacauauuucaggcuguugcguaccauauggaugaugcacagcuggaugugagucugcggauaaacacugu

SEQ ID NO: 4253087 - RNA, 127 nt, Yersinia pestis
gcaagucuggccccucuucaccagucacugacgaucauuuuggacuuaauucgccagucaugcccuuuacguagccagauaaguuuaaaugguuucuuucaggauaaugcugggggagcugaccugc

SEQ ID NO: 4253088 - RNA, 79 nt, Yersinia pestis
gaacgccuuaaucgccguggugagcggguauggcuggaggccaguuauaacccgaucauggauaaugaagggaacguuc

SEQ ID NO: 4253089 - RNA, 56 nt, Yersinia pestis
ugccaagcacuuugcggcuuuaucgaccaaugccaaagccguuggugaguuuggua

SEQ ID NO: 4253090 - RNA, 102 nt, Yersinia pestis
gccgagaguggcgggacucacuauaaguuaauuauuuacucugaugaguauuuuaaguucauuagcagugaugguuauuuauuugaguauggauacgauggu

SEQ ID NO: 4253091 - RNA, 61 nt, Yersinia pestis
cuguuagccgugaaugaacucgggcugccgaccgcuaccgaguuccucaauaugguaacag

SEQ ID NO: 4253092 - RNA, 66 nt, Yersinia pestis
ucaacgccuuguucgcaaccgaagaucaggucgccuuuaucuuuuucugcuaaugcgggcaguugg

SEQ ID NO: 4253093 - RNA, 58 nt, Yersinia pestis
auguuaacugauauauaaauuaaggccggauaccggccuuaauuuauaucguuaaugu

SEQ ID NO: 4253094 - RNA, 60 nt, Yersinia pestis
uacuggaagccagagcagggauuguuaacuggaacaaaccauugacgggggcuuccagug

SEQ ID NO: 4253095 - RNA, 55 nt, Yersinia pestis
cgguguggugcaguuaugguugaucuccccuaauggcggagaacugcgccaacug

SEQ ID NO: 4253096 - RNA, 118 nt, Yersinia pestis
uuuuauggacauuuuuuuauggauauuguuauuuguagacauuguuauugguagauauuuuuuuauaaaacuuguuguuuauaaacguuauuguuuauaaaaauuauuguuuaugaag

SEQ ID NO: 4253097 - RNA, 60 nt, Yersinia pestis
gugguccauaaaaauagcccugucugccacaucgcgggcaaagcucauuucaugggucac

SEQ ID NO: 4253098 - RNA, 58 nt, Yersinia pestis
acugauuuuguggcaacagcaccaaaaugcuuuuggguuuacuuugcuuaaagucagu

SEQ ID NO: 4253099 - RNA, 74 nt, Yersinia pestis
acgcuggcugauacgcccacgauugcggccagguuacuggcaaaugaagucaccgggcguaccuuagucaaagu

SEQ ID NO: 4253100 - RNA, 113 nt, Yersinia pestis
gcggucaaugccgucuuuuucaagcuggcgaauaugacgagcaguaauacgacgcgcuuucucgacguaaacuuugccauucgcuucaauaucaaaggaugccguuucaccgc

SEQ ID NO: 4253101 - RNA, 107 nt, Yersinia pestis
ggaagucagcaaggguggcaaaguaaugcgggugugagugcugguauauccaugcgcuaucaccaagcauuauuugauguggaagccagccgugguugguggcuuuc

SEQ ID NO: 4253102 - RNA, 65 nt, Yersinia pestis
ggaugaagaacggcgguuggcuuauguggggaucacccgcgcccagcgugaacuguucuucaccc

SEQ ID NO: 4253103 - RNA, 70 nt, Yersinia pestis
uccacggauuauggccgauaagacauuagucgaauuuauuaccgauuauuuacggcucauagugagugga

SEQ ID NO: 4253104 - RNA, 88 nt, Yersinia pestis
uguguggcucauguugguuaagguuagcgguguaguuaagguuagcuaugcaguuaagguuagcuaugcaguuaagguuagcuaugca

SEQ ID NO: 4253105 - RNA, 76 nt, Yersinia pestis
uggcggcggaagaccaaccacucagucaggaucucuaacaacccuuugacugaugggcgguuauccaaaccgauca

SEQ ID NO: 4253106 - RNA, 90 nt, Yersinia pestis
uguggucuaugcccgugauuuauggggauggauaaaauguuauggauaucaauaagccguauucauuauccccagcgguaucagccuacg

SEQ ID NO: 4253107 - RNA, 59 nt, Yersinia pestis
ugaucgucagccguacccgcucucucagccacugaguaguggccagacgguugagauua

SEQ ID NO: 4253108 - RNA, 63 nt, Yersinia pestis
gaucccucguggagaggcucaacguuauauggaucucuauuuugagcguuauccggggguguu

SEQ ID NO: 4253109 - RNA, 68 nt, Yersinia pestis
guugcacucgauucuuguucugcaacgguguuuugcaccugcucuacaggcaauugcgcagugacaau

SEQ ID NO: 4253110 - RNA, 63 nt, Yersinia pestis
cauugucaugcagaaucgaaacugcgugauauuuccguagucuaucguuaucugauggcagug

SEQ ID NO: 4253111 - RNA, 108 nt, Yersinia pestis
gccuguugggcaguuaauuucccgaguaaccaaugacaccgaagugaucaaagauuuauaugucauggugguuucuacgguuuugaaaagugcggccuuaauuagugc

SEQ ID NO: 4253112 - RNA, 58 nt, Yersinia pestis
cauugguuugguacgcaagccaaagagaaagguuugguugaugcuaucggcaccagug

SEQ ID NO: 4253113 - RNA, 55 nt, Yersinia pestis
uccgcauagcuugcaacccaucgagccgagccugauggcgagugagcugugucga

SEQ ID NO: 4253114 - RNA, 102 nt, Yersinia pestis
aucuuguaacaucuggcugucuacuugaauggaaaucccggccaaugguauuucagggcuggcaaacguuucacacucaaacggcagcggaacacucaggau

SEQ ID NO: 4253115 - RNA, 90 nt, Yersinia pestis
ggggcggggaaaaguacccugaugaagauccucgcuggcgcauauaccaccaccagcggcgagauccuuauugaggguaggccuuggucc

SEQ ID NO: 4253116 - RNA, 62 nt, Yersinia pestis
guugacguguuguaugccguuaucgauccaaaaauccguuacuaguacuggagcacgucaau

SEQ ID NO: 4253117 - RNA, 59 nt, Yersinia pestis
gcugggcaccgauaguuauggccgcgauaugcugucgcgucugauuuacgguacccggc

SEQ ID NO: 4253118 - RNA, 81 nt, Yersinia pestis
gccagaugacugugaagauuacguucaccgcauuggccguacuggccgugcuggcgagaguggucacuccaucagucuggc

SEQ ID NO: 4253119 - RNA, 76 nt, Yersinia pestis
ggaaaaaccgcacggucgugauacuacguugguugccuuagguggcggcguagugggcgaccugaccgguuuugcc

SEQ ID NO: 4253120 - RNA, 57 nt, Yersinia pestis
aaaaaagcccgguuacucaauauugggguuaguccaauugagugaccgggcuuuuuu

SEQ ID NO: 4253121 - RNA, 77 nt, Yersinia pestis
uucagccgcaauggucagcaaagugccgaguuacguuugcauccacaagagcugggugccuugcagaucagucugaa

SEQ ID NO: 4253122 - RNA, 59 nt, Yersinia pestis
gauucagccugugacaccaucaccgcuugcgacgcagccauggggucaucggauggauu

SEQ ID NO: 4253123 - RNA, 61 nt, Yersinia pestis
cggugagcgaugauaaucaccguccgguugugaaccagguuaucgaucgcuuuuugcaccg

SEQ ID NO: 4253124 - RNA, 57 nt, Yersinia pestis
auucaugucagugcuaucacucuuggaaauauuuucaacgauaucauugaaauggau

SEQ ID NO: 4253125 - RNA, 74 nt, Yersinia pestis
caaucaugauauggcgagcccccuccgcuuucgcuuguuuuagcugcgcuuccagcucugucauaucauuguug

SEQ ID NO: 4253126 - RNA, 60 nt, Yersinia pestis
guuauuuuuggagucuccuggcucacaaagcuucgaaauucaggauauuccgaugaugac

SEQ ID NO: 4253127 - RNA, 129 nt, Yersinia pestis
cgccugacgcaccuuccaauaaguauuucggccuuugacaugcaguucagucaggaagcagaccgccuccauugaacccgugucauuaaggguauugauggucuuuuggaucacuugcuuguauuggcg

SEQ ID NO: 4253128 - RNA, 65 nt, Yersinia pestis
ugucgccgguuucaagcgucagguagcccaguugauggaguugcucgcacagggucuggcguaca

SEQ ID NO: 4253129 - RNA, 56 nt, Yersinia pestis
auaagccaccugcgugaugugaaccucuaucguggucauuucaucugguggcuuau

SEQ ID NO: 4253130 - RNA, 60 nt, Yersinia pestis
ccuucaaggcugaauaaugccugauauugcuuggucagugcauuuuucggcucuuuaagg

SEQ ID NO: 4253131 - RNA, 85 nt, Yersinia pestis
gccaaagauaacagcggcuaacguugaauauuucauuuuauacaguuucuuaguuaaauuucggcguuaguaugccauaucuggc

SEQ ID NO: 4253132 - RNA, 68 nt, Yersinia pestis
gcucauuaauuccgaugagcuuacugacuuuaaagucaacgaccaguaagugauucggguuauugagc

SEQ ID NO: 4253133 - RNA, 55 nt, Yersinia pestis
ucugguuuuguaacagagcagaaagcagcagcuuuugugcaggaguaaaaccggg

SEQ ID NO: 4253134 - RNA, 55 nt, Yersinia pestis
uuggcugaaguuaaucucaauggcgaaugccauuggccgaggugauuuuagccaa

SEQ ID NO: 4253135 - RNA, 76 nt, Yersinia pestis
gccgucuggacaucucuuacuccguugacuggugaagcaugguguuguuaaaacagcggauaauggauccgauggu

SEQ ID NO: 4253136 - RNA, 86 nt, Yersinia pestis
guugcgggagaaaucggugcugacaccacaggauuuuaacggggaaaauuuugucagccugucagucaccgacaguuaccgucagc

SEQ ID NO: 4253137 - RNA, 100 nt, Yersinia pestis
gucaggaggaugaucucacgguugaugagaaagaugcgcuguauacugauccugguucggcagcacauuuuauucaggcgacagggauagacucucuggc

SEQ ID NO: 4253138 - RNA, 64 nt, Yersinia pestis
cguuuuacaucagaugugaugacuucaaucuugcugaccacaacgucaaacaucugaugagacg

SEQ ID NO: 4253139 - RNA, 63 nt, Yersinia pestis
ggcauuccguaucuauuggccugccgcgaaaaucaucauugcggcggauaaugauaucaaucc

SEQ ID NO: 4253140 - RNA, 81 nt, Yersinia pestis
cuguuguagaagcaguuuccaaugagaaaucccuuccgcgcgagaagauuuuugaggcguuggaaaccgcucuagcgacag

SEQ ID NO: 4253141 - RNA, 64 nt, Yersinia pestis
ccugacauaggcuagcugauaaccuauguuaauauuauuuggucagcagauuaccuauuucggg

SEQ ID NO: 4253142 - RNA, 71 nt, Yersinia pestis
gcugguugaucaacugcugacgcuguaauugagcaaauugcucugggguguagcccaguugguuaaucagu

SEQ ID NO: 4253143 - RNA, 95 nt, Yersinia pestis
accauugacgaaauuuuuuauaacgcgguagcaguaauuuauaacguaguaacaguaauagugcugccaucaccgcauagauaaugggccaaggu

SEQ ID NO: 4253144 - RNA, 86 nt, Yersinia pestis
caaccgccaaaaacauggcaagaacuggcagcagauaccgcuaagcuacgcgcugcggguucuaguugcgguuaugccagcgguug

SEQ ID NO: 4253145 - RNA, 86 nt, Yersinia pestis
guucacgucguugcucaguugaucaacuuuagcguucagagucugaacgucagaagacaguugaucgauuuuagcauugcuugaac

SEQ ID NO: 4253146 - RNA, 129 nt, Yersinia pestis
accggaugagccauugccggaacaacccucucuguuuuaaucguuuugugcuuuuuaggugauuuuuggcucucaacuucccgagagacgcugaauucauugauacagggggugauccuggcugcuggu

SEQ ID NO: 4253147 - RNA, 57 nt, Yersinia pestis
cacuuugucaguaaccgcaguaucgccauaaacggggguacugcugcuagacaaaug

SEQ ID NO: 4253148 - RNA, 72 nt, Yersinia pestis
ugaucgcgggagcguuagcgggcggcuuagucggcggugccgaucugauucaaaccauuaaccucaugauua

SEQ ID NO: 4253149 - RNA, 63 nt, Yersinia pestis
caaucguuguuucugauagcgaacagacuaaugaaggucgucguuucugggagcgaaugauug

SEQ ID NO: 4253150 - RNA, 83 nt, Yersinia pestis
uucguagucuguugcguggucugagcgguugguuguggauuguuauccacuugccaagcuugccagaucaugaaagacacgaa

SEQ ID NO: 4253151 - RNA, 72 nt, Yersinia pestis
cccaccgucggcguggauaucggcgcuaaagauacgauuuaucagcugauccaaacgcuggcgcagcaaggg

SEQ ID NO: 4253152 - RNA, 64 nt, Yersinia pestis
gccacaagcaacauuaucgucugguugacuucaaacgcaacaaagaugguaucccugcuguggu

SEQ ID NO: 4253153 - RNA, 81 nt, Yersinia pestis
aguuuuaaccaaagcggaucgucgauagguugguccaugccagcgauggucucuuuauugaugauuugcccgcgaaaaacu

SEQ ID NO: 4253154 - RNA, 84 nt, Yersinia pestis
gguacgcuguucuacacgcgcugcuucaacauuguaggcaauucgcucuacagggcuauagcaugcgucuacuaacagacgacc

SEQ ID NO: 4253155 - RNA, 74 nt, Yersinia pestis
aggugaauaauaaacuggcuaauacauucgcuauguuagccaugcuggguguugugauuaguuuuuuuucaucu

SEQ ID NO: 4253156 - RNA, 58 nt, Yersinia pestis
ggcucaaugauugaauuuggcgauuuuuaucggcugauugccaaaggcccauuaagcc

SEQ ID NO: 4253157 - RNA, 64 nt, Yersinia pestis
gcauaugauauugguuuuggcgguuuggaccauguccugagccugacagaaaaugucaaugugc

SEQ ID NO: 4253158 - RNA, 61 nt, Yersinia pestis
auuuugauggcgaugggaaugaugaugcuaucgcccuuaauugucucauugccauuuaaau

SEQ ID NO: 4253159 - RNA, 64 nt, Yersinia pestis
cgaaccgcucaucgcuuccccccuguaacaucccgugugcaggggguaaaucgaugagugaacg

SEQ ID NO: 4253160 - RNA, 56 nt, Yersinia pestis
gcagacuauauucuggcaaaugcuaaugggauuagcugucagggauguaguuuugc

SEQ ID NO: 4253161 - RNA, 55 nt, Yersinia pestis
ugggcauuguucucaauugagaggaggcguuauucucaauuaggagccgugccca

SEQ ID NO: 4253162 - RNA, 130 nt, Yersinia pestis
uuggcaaacgucaaccgguuggugucggugauuuaaccagugguuuauugcuggugaauuuguugaaaggugagccauuggauaaagcacuggaacaugucaccgccgccguguaugaagugaugcucaa

SEQ ID NO: 4253163 - RNA, 61 nt, Yersinia pestis
aaacucguaauaucuuuaaagcgaucccuucagggauacucacagggauaauuaucgguuu

SEQ ID NO: 4253164 - RNA, 69 nt, Yersinia pestis
caaucuuaccgccgucagguucagguguugggcgagacccgcgcaagacugaugcaagauggcgguaug

SEQ ID NO: 4253165 - RNA, 129 nt, Yersinia pestis
aggcgucaucguggucaccgugauaggcagcgacggguaacgguggcguaaugcucugaccaaugggauugcagccaguguuuccccgacugaaacggaaugcagcaugauaccgccagcaacgacuuu

SEQ ID NO: 4253166 - RNA, 95 nt, Yersinia pestis
guaaaaccaugcucaaaaauggauuaucugauaugaaugaacugccaccauugcguagcaaaccauugauguuagugauuuuagagugguuuaac

SEQ ID NO: 4253167 - RNA, 59 nt, Yersinia pestis
ggugcaacuaaacgcccggacuuaguggauguuauuuuuccgggcggcuuaauuguauu

SEQ ID NO: 4253168 - RNA, 55 nt, Yersinia pestis
gccaguuugagucuuuugucagccgauuuauuggcaaugggcacacgagcugugu

SEQ ID NO: 4253169 - RNA, 61 nt, Yersinia pestis
gccgugauaaauaacccgaaucaccuaccagaguaagugauucgggcuguuuguuuacugc

SEQ ID NO: 4253170 - RNA, 63 nt, Yersinia pestis
cuguucuauugucuuauugucugaacucauaacuauugagugaaccagugccacaauaaacag

SEQ ID NO: 4253171 - RNA, 58 nt, Yersinia pestis
ccagccagcauucauuuuggggauguauuccuacguuagcaugaugauuguugucugg

SEQ ID NO: 4253172 - RNA, 76 nt, Yersinia pestis
gcaguaaagcauaacagcuugcugccgaggcggauaaaacgcugcgguagcaagucuguuauaaagauaagucugc

SEQ ID NO: 4253173 - RNA, 73 nt, Yersinia pestis
ggcaagcgcggucauugccaucgccacuuuuccgcccauggaauggccgauaauaauggcuuguguuauugcc

SEQ ID NO: 4253174 - RNA, 57 nt, Yersinia pestis
ugcccaaaacauaggauugaucaggacagcgaugggaugaaauccuauuuuugcgca

SEQ ID NO: 4253175 - RNA, 102 nt, Yersinia pestis
augacagcaguuaacgguaaauaguaauuaauucuaaacgguaacucacucucaauaguaaccaauuguaaauaauaacuagcugcggguugccgcuuucau

SEQ ID NO: 4253176 - RNA, 64 nt, Yersinia pestis
caggaacuaauggaguguuauuaaccuugacggccuuaauggcaucuucuuuagucuuaucuug

SEQ ID NO: 4253177 - RNA, 101 nt, Yersinia pestis
ggcgcucauggcaaugcuguugauuuuuugaugaauuacgaucgacucgaguuugucgaaaguaucgaagaauuagccaccaugcacgggcuggaagugcc

SEQ ID NO: 4253178 - RNA, 62 nt, Yersinia pestis
gauuacgguuuaccagaaugacacauuaucauugauaaaaaguuguguugguaaaccguauc

SEQ ID NO: 4253179 - RNA, 78 nt, Yersinia pestis
cguugcauacuagaaccuaucucgucagugguuuuuuuaaucguaauuacuggugagauaggcucuggaaauacggcg

SEQ ID NO: 4253180 - RNA, 68 nt, Yersinia pestis
uguuuauaaguaaauguuuauagguaaguguuuauaaaaaauggcuuaucaauguuggcuuguaaaua

SEQ ID NO: 4253181 - RNA, 71 nt, Yersinia pestis
ccgcauuaugggcaggggccgccgcgaccaucaucuauaccuuuauugggggguuccuggccguaagcugg

SEQ ID NO: 4253182 - RNA, 55 nt, Yersinia pestis
gggggcgaucagcgguaaggugaccuuacgaaagacccgccacugugaugccccc

SEQ ID NO: 4253183 - RNA, 93 nt, Yersinia pestis
cguaguaauacaaagguauuuacugauccaaaaugguuuuuugguaccagaaucuacguuuugaucagggcuaagaaccugggugggaauacg

SEQ ID NO: 4253184 - RNA, 61 nt, Yersinia pestis
cugguggaaauuaucgaguuaccagaccacccgugguuuguggcuugucaauuccauccag

SEQ ID NO: 4253185 - RNA, 77 nt, Yersinia pestis
uggcuuuaaggucauggaaggugaaauuaaaaucuaacuuuggauauguuuuuugcgacuucccuggcuuugugcca

SEQ ID NO: 4253186 - RNA, 64 nt, Yersinia pestis
uagcuaucggugaugagccgaccgaagguuuugaccccauguuaggcuggagucacgguagcua

SEQ ID NO: 4253187 - RNA, 62 nt, Yersinia pestis
ccagcuugaacagcagguuauccaguugucacgccguuuggacgacguguugauucaacugg

SEQ ID NO: 4253188 - RNA, 64 nt, Yersinia pestis
gcccaacuagguuaccacggcccugggacaguuuauucauugccuggugauagcuuagcugugc

SEQ ID NO: 4253189 - RNA, 56 nt, Yersinia pestis
uuccuggaggcaaaguugaggcuggagaaacucagccucaggcgcugauccgugag

SEQ ID NO: 4253190 - RNA, 62 nt, Yersinia pestis
caggcuaugugcugguccagauggucaugaaugaugccagcuggcacuuaguacguagcgug

SEQ ID NO: 4253191 - RNA, 63 nt, Yersinia pestis
cagcgcgaugguguauguuaucuggagugcuacaaaccugucccuaaacgcaccauugcguug

SEQ ID NO: 4253192 - RNA, 55 nt, Yersinia pestis
guggcuagcguauuaaugccaguuauacccgccaaacuguaugugcguuggcuac

SEQ ID NO: 4253193 - RNA, 55 nt, Yersinia pestis
ugcacugaaccccagaucuuggaucuuuuuauccaugaucuggagguucgguuca

SEQ ID NO: 4253194 - RNA, 62 nt, Yersinia pestis
cccaaugagcuuauuccugucagugagugucgcuaacucgcuacagcuuuaagcccgaaggg

SEQ ID NO: 4253195 - RNA, 70 nt, Yersinia pestis
guaaaguuaccguucugagcaaagggccucuuaaugagggagccacuuuuuaugcucagggagguauugc

SEQ ID NO: 4253196 - RNA, 55 nt, Yersinia pestis
gaauucauaagguagacuuggaucacaaaaguccaaaaacuuugccuuagaauuc

SEQ ID NO: 4253197 - RNA, 66 nt, Yersinia pestis
aagggauuucagacaaguuagugccuaaugcaaaaccugcguuagauugcccgguugucuucccuu

SEQ ID NO: 4253198 - RNA, 118 nt, Yersinia pestis
gauaugcgauuaaccauuacacuuaugauuaacgccaugaaccuacgauuaauccuauauacuuacaauuaaucugauguguaaggaugcaaucaggggcaauaaucguuagcauauc

SEQ ID NO: 4253199 - RNA, 65 nt, Yersinia pestis
gguugcugauucgucgcaauuuacuguuuaugcugauaagccuugaagugaugaucaacgcagcc

SEQ ID NO: 4253200 - RNA, 91 nt, Yersinia pestis
caguuuccauauggucauugcccgugucgucaacggcgcuuugcaaguuuuagggcgccugaaacaacgcgugcaucuggccgauggccug

SEQ ID NO: 4253201 - RNA, 90 nt, Yersinia pestis
gcuacauuuggugaguuuaauucuuuucuaauugcggcucugacaucacaacugagagcuagcaagaagaauugaucauuauuauguagc

SEQ ID NO: 4253202 - RNA, 60 nt, Yersinia pestis
uuggcgcagguaauaugcgguuggauaaccaacccgccucaaccgcgacuugccagccaa

SEQ ID NO: 4253203 - RNA, 106 nt, Yersinia pestis
gagugguguguagcgcgcgugaggaugccguagauuuuuuugccaaacuggguuuuguuugucagggagagauaacggcaccgcaaacgacaccuguacgccauuu

SEQ ID NO: 4253204 - RNA, 78 nt, Yersinia pestis
gccagcgcagcguccugacgcugauccgcgccauugauacugauagucacacccaucaguguuggaucuuguguuggc

SEQ ID NO: 4253205 - RNA, 58 nt, Yersinia pestis
ggcugcuaauaccaauaauagaggaucauccccacucauuguugcucguaaggcagcc

SEQ ID NO: 4253206 - RNA, 64 nt, Yersinia pestis
uggccuuuuaauauauugaagccuuuuaauauaccaaagggcauuuuuaauauguugggggcca

SEQ ID NO: 4253207 - RNA, 57 nt, Yersinia pestis
ccggcaucaagcauuuggucaauaacggcguuauagcgaucaaaacgcuugguuugg

SEQ ID NO: 4253208 - RNA, 67 nt, Yersinia pestis
gauaaauuucuuuugucuguauaccgcaugaugcuaaucagguagucagaugaaaaggucauuuguc

SEQ ID NO: 4253209 - RNA, 61 nt, Yersinia pestis
uuucgaagaacuggcauugcguuuuauggauauccguaaacgcauuuauaaguucccgaaa

SEQ ID NO: 4253210 - RNA, 62 nt, Yersinia pestis
aucagcaaugaaacccugcaaaagcugcugcaugauuuggauuugcuggaagcguugcugau

SEQ ID NO: 4253211 - RNA, 75 nt, Yersinia pestis
gguagcuacucuguuagcgguguaucuggugcauuaaccucauuaacugauacaucaguaacagguguaacuacc

SEQ ID NO: 4253212 - RNA, 75 nt, Yersinia pestis
uugaguagugccuuacguagcaugacgauagcauaggcccuugcgguuucuucaucuuguaagaguucugcccga

SEQ ID NO: 4253213 - RNA, 84 nt, Yersinia pestis
acuggaauuaggcauggcgaccggugaugacaaagacauuaaaaaugucauugcaauggugccgguuauucaagccacgacagu

SEQ ID NO: 4253214 - RNA, 55 nt, Yersinia pestis
ccagcugauuuauuccaacugaccgcagguaaguugacgggguuagaucggaugg

SEQ ID NO: 4253215 - RNA, 55 nt, Yersinia pestis
uagcuauccaguuggucaaucccaauacggguuuuuaccgucaccggaauagcua

SEQ ID NO: 4253216 - RNA, 71 nt, Yersinia pestis
guucucugccacucuugaaggugaagccauccgcgaauuugcggagcgcauucucaaugagccaguagaac

SEQ ID NO: 4253217 - RNA, 68 nt, Yersinia pestis
guugcccacauuuggcaaugaaugccgauauugcgcagguauugacacauuuauugccaaugaucgac

SEQ ID NO: 4253218 - RNA, 90 nt, Yersinia pestis
aguguauagagaggauuaaagcgguaaucaguagucauugucaaaauucaccgcaaagauuauugguuaguugcgaccuugagguacacu

SEQ ID NO: 4253219 - RNA, 92 nt, Yersinia pestis
gcaagauguacaagauuuugaguuuauaauuucagaggcuaucagaauuaaggauaguuugagaaaugaagacuuuaaaucuuuuauggcgc

SEQ ID NO: 4253220 - RNA, 55 nt, Yersinia pestis
gcucugcgacgggaagcggugcuaucgccauaaaccgcucaauccguugcagggc

SEQ ID NO: 4253221 - RNA, 73 nt, Yersinia pestis
gcgaauaccauugagaaaacucuuauagugcugcccgauugacggaagcgcugguuuucucgacaaauuucgc

SEQ ID NO: 4253222 - RNA, 61 nt, Yersinia pestis
cgaugccauauuuacauucgcgauguuauaucuauauuuccgauauuauauaucggcaucg

SEQ ID NO: 4253223 - RNA, 58 nt, Yersinia pestis
uugcuaucuuugccguagugaugcgcuuguuuauguacgcaccggcggcggauagcga

SEQ ID NO: 4253224 - RNA, 62 nt, Yersinia pestis
gagaaauauuggcagucaucugcuacguuuaaauaggccgugauaucugccggauauuuuuc

SEQ ID NO: 4253225 - RNA, 66 nt, Yersinia pestis; identical to SEQ ID NO: 4227284

SEQ ID NO: 4253226 - RNA, 97 nt, Yersinia pestis
uacgcgggugccauuauggugcuguucguguuuguggugaugaugcugaaccugggcaacgucgagcaacaagagcgugccuggcugaaacccagua

SEQ ID NO: 4253227 - RNA, 78 nt, Yersinia pestis
ccucguagcuaucagcccuggaugaagaugauccacuuuuccugugggaucgccauccugguguugaugaugacaagg

SEQ ID NO: 4253228 - RNA, 56 nt, Yersinia pestis
gcgguuuugcuguaguggccagugaaguacgccaccuggcgcagcgcagaugccgc

SEQ ID NO: 4253229 - RNA, 60 nt, Yersinia pestis
agcgacuguaccaugccgaucauuggaaugaugaugucuugaucggccagugccagcgcu

SEQ ID NO: 4253230 - RNA, 57 nt, Yersinia pestis
gaagauacuuauguuguuaauuaauugaucugugagauacagcguuucggugucuuc

SEQ ID NO: 4253231 - RNA, 114 nt, Yersinia pestis
gccuuguuggacaagaaugcggugccuuaucuggucgcgccacugauugcgaauccgcguacuggcgcggugaccgguaacccacguauucguacccguucgacauugauuggc

SEQ ID NO: 4253232 - RNA, 55 nt, Yersinia pestis
ccagagauggauuacuuuauggcagucuuugugccaaguuuuaguuuaucucugg

SEQ ID NO: 4253233 - RNA, 72 nt, Yersinia pestis
ugguguuauugcccggcaacuuuauaucgaaaugcugaaaggcggauauacccaaguugcugaauuucacua

SEQ ID NO: 4253234 - RNA, 55 nt, Yersinia pestis
uguucaacgauccuuacuuucgguuaccugcgccgaaaaguaccggucgugaaua

SEQ ID NO: 4253235 - RNA, 92 nt, Yersinia pestis
ugcaggggcgucuugcgucauggucgguucuauguuggcugguacugaagagucuccgggcgaaaucgaacuguaucaaggucgcuccuuca

SEQ ID NO: 4253236 - RNA, 70 nt, Yersinia pestis
ggaguugaucgagacugaaaucaugcacgguuuggguuacccagacccguauauuucagagaaagacccc

SEQ ID NO: 4253237 - RNA, 56 nt, Yersinia pestis
ucacccugaauuugguguguugaguagcgaugacccaacauaucuugcacggguga

SEQ ID NO: 4253238 - RNA, 64 nt, Yersinia pestis
cauucguuuagagcgcacgggguuuaaagauauuuuuucaccucugauuaucucugaacaagug

SEQ ID NO: 4253239 - RNA, 69 nt, Yersinia pestis
gacgcuaucuugaugaugccugauauccucaauccugccgggcauuaauuucaacauuaaaguaccguc

SEQ ID NO: 4253240 - RNA, 72 nt, Yersinia pestis
cuauggaacguaacaucaauuaacguaacguuaugaauuaauguagcgucauaaauuaaugucacgucauag

SEQ ID NO: 4253241 - RNA, 56 nt, Yersinia pestis
ggcucacuggaagccgguuaucacuacagccugucgaauaauugguucguagagcc

SEQ ID NO: 4253242 - RNA, 60 nt, Yersinia pestis
gucuaucuguuacaaacacgcaauacguuaaaccgugccgguguucguuacaugauggau

SEQ ID NO: 4253243 - RNA, 56 nt, Yersinia pestis
gcgauugagcggggugagucuauuugugauuuugccgcgacaaccccgccaaucgu

SEQ ID NO: 4253244 - RNA, 99 nt, Yersinia pestis
auugcgaaagauccagaacugguugucgagcuggcauggugggcaaauaauauugguguaaccggugcugcguuugacagcuaucuacuccuucguggu

SEQ ID NO: 4253245 - RNA, 95 nt, Yersinia pestis
gcguccagugguuaucauugguggccaagggcagaugggucgguuauuuagccggaugcuuaaucugucugguuaucaggugagaacacuggagc

SEQ ID NO: 4253246 - RNA, 80 nt, Yersinia pestis
guuguaaguuuuuuauaaaugccguagcgcuguuucuuauaaauaccguagcgcuguuuuuauaaauaacccccugcaac

SEQ ID NO: 4253247 - RNA, 100 nt, Yersinia pestis
cggaaccuuauuuggugugcugauaauaggugugaugaacaaugggcuugauuuacucggcguacaauccuauuaccagcaaauuaucaaagguguucug

SEQ ID NO: 4253248 - RNA, 66 nt, Yersinia pestis
gaacagguuaaugacaugggccagcgauuuggcaaaacgccgcucauaauuguucauugccuguuc

SEQ ID NO: 4253249 - RNA, 64 nt, Yersinia pestis
uguucuugauugguuaugguaccuuccgcaucauuguggagugcuuccgccaaccagacgaaca

SEQ ID NO: 4253250 - RNA, 65 nt, Yersinia pestis
acuaaugguuuuaugugcacuauuuuugaugaguacaaugguaauggcaucauauaauuauuggu

SEQ ID NO: 4253251 - RNA, 129 nt, Yersinia pestis
ccaaccaucaaccgacgaucucuuuguaccgucgagcccgugauuugaaagggaucaaaaagauccugaucgccuccggcguucgcuacgauuuggcaguagaagauccgcguuauaucaaagaguugg

SEQ ID NO: 4253252 - RNA, 73 nt, Yersinia pestis
aagguucugccgggcuggauuuacgugcuuguuuagaucacgcaguagaacuacagccuggacaaacaaccuu

SEQ ID NO: 4253253 - RNA, 85 nt, Yersinia pestis
guucaugcaauugcugaggugcgcugauuuuuguuuguacugaaaauugaugcuguagcacauccaucgguaauugcgcaugaac

SEQ ID NO: 4253254 - RNA, 65 nt, Yersinia pestis
gacgucgccgcauuggugggugcagacccucgugagaucgucuucaccuccggugcgaccgaguc

SEQ ID NO: 4253255 - RNA, 82 nt, Yersinia pestis
ggguaacggcucugccaacgugaucgccgcuaauuuucccugugcaaucaagggcgauaccauaugggcgggcaccaugccc

SEQ ID NO: 4253256 - RNA, 64 nt, Yersinia pestis
uguucccgcagaugccaguaccacgacacaacugauguggcuacugcuggcacugaugggggca

SEQ ID NO: 4253257 - RNA, 55 nt, Yersinia pestis
guucacugucgguaaagucuucaaccagauugaacucugcuuguaccacaggaac

SEQ ID NO: 4253258 - RNA, 80 nt, Yersinia pestis
guagaacgaaaccaguagcaacacaaccaguaacggcagaguaaacgccugcugcgugaguuuugcauucauaguuuuac

SEQ ID NO: 4253259 - RNA, 60 nt, Yersinia pestis
cgucaguagacucaucaaucuucuccccgaacuaaugugaagaaaucgacuuuacuggcg

SEQ ID NO: 4253260 - RNA, 58 nt, Yersinia pestis
agugcguucagugccguugaccgaaggcauugauuuuuuuggcgagcuggaacgcgcu

SEQ ID NO: 4253261 - RNA, 70 nt, Yersinia pestis
ggcagucuguuuuguuggguugucauucgcguuguagcgaauaacguuagaaaucaacauagcauuugcc

SEQ ID NO: 4253262 - RNA, 86 nt, Yersinia pestis
caggcgacgcuguguggcagguaagauucgaaacauucucgcaggauauguuucuccauuuugccauugccgcacauuuuauccug

SEQ ID NO: 4253263 - RNA, 81 nt, Yersinia pestis
ggucuggagcguuuggcgauguacauucagggcguagacagcguuuaugaccugauauggugcgacggcccgcuggggacc

SEQ ID NO: 4253264 - RNA, 72 nt, Yersinia pestis
ugguggaucugggaugcacggcugacaucggaauuaguccuguuauuccuguaucucggcgugaucgcgcua

SEQ ID NO: 4253265 - RNA, 67 nt, Yersinia pestis
gcuccguggagcucaggggauccagaacaccuuugcaugggcgucauuccucugggguuacggcggc

SEQ ID NO: 4253266 - RNA, 60 nt, Yersinia pestis
uucgguaugaguuuauugcuuugggcuaucgccuucaucgcgauugaaagucacaccgag

SEQ ID NO: 4253267 - RNA, 96 nt, Yersinia pestis
gggccagccgccucggugacaaaucucugggcgcagggggguuuuaugccccauggcuuucgugguuugaucauggcaauggcgguuauuauguuc

SEQ ID NO: 4253268 - RNA, 57 nt, Yersinia pestis
ccucgggucaucacguagaucaggucgaaggauuugaaggcgucgaucauccgcagg

SEQ ID NO: 4253269 - RNA, 90 nt, Yersinia pestis
agccauugcgaugggcuggaaaccggauaugucacauguucacccuaccgguaaacguguggccgugaucggggccggcccugccgggcu

SEQ ID NO: 4253270 - RNA, 66 nt, Yersinia pestis
acguuguaugaacauggugugcaaacgugccauuacagcgcugacacaucaauguuacaucgacgu

SEQ ID NO: 4253271 - RNA, 84 nt, Yersinia pestis
gguuaugaauuaccgcgcgaacugaccuauuaagauugaguaagauaaaucuuauagguagaauucgccgcgugcuaacuggcc

SEQ ID NO: 4253272 - RNA, 104 nt, Yersinia pestis
uugccguuuguucagaucaaauacgccggcgcguuaguacuggguagcuauuauaaagaugcuacaccugcacagcgugaagcguauuucaaugcauucgguaa

SEQ ID NO: 4253273 - RNA, 72 nt, Yersinia pestis
ugauacccgcggcugaauaugaaagacgaucuaacuuaccggaaaucgacugauauucagcgauggcaauca

SEQ ID NO: 4253274 - RNA, 60 nt, Yersinia pestis
ucugguauuccgcauugucaauuugugcuugagcaucgaucaacacagcaggaagccgga

SEQ ID NO: 4253275 - RNA, 59 nt, Yersinia pestis
gguaccugaugugguuguaauagcgaccaauuucgcuuuuacacccauuuucgggaacu

SEQ ID NO: 4253276 - RNA, 70 nt, Yersinia pestis
guuuuugggauauugaacaaggccauauauugguuggcgauaaagcuaaugaaaugagucuugcagagau

SEQ ID NO: 4253277 - RNA, 100 nt, Yersinia pestis
aguggugcggguacgaccaccaccagucuggcuuuucgcaaaauuuuucagcaguuagauauucgcgcagcacagauugaaggugacaguuuccaucgcu

SEQ ID NO: 4253278 - RNA, 100 nt, Yersinia pestis
aauaaaauguaggauuaaagucuuagugugaguacaucuauuaauuuauuauuaaaaauaauggacaccccagacuuaggcucugauuaaagguuuuauu

SEQ ID NO: 4253279 - RNA, 128 nt, Yersinia pestis
uaguaugguugccagcaccaaagcuaacccugucuuuuucaucacuccuccacgcauuauuauuccuaucuagugacuggagugaugauugaaacacagguuguaaagugaacagcacaaccaaacug

SEQ ID NO: 4253280 - RNA, 65 nt, Yersinia pestis
gaucagccaccacaauggcuguuuuacccuguuuccgggcuaaagcaacggugguagcgaugguc

SEQ ID NO: 4253281 - RNA, 89 nt, Yersinia pestis
ccaugcaucggagggauuuuugcaguaguccuuaccuuuaauaccaccguaaggauaccauuugucagggucuucaccgguaagcagcg

SEQ ID NO: 4253282 - RNA, 86 nt, Yersinia pestis
cuacagcuuugucaauaacaugacgaccuuugauagcuuggguaaccgccaugaaaucaaugucuuuuauguuaaacgugcugaag

SEQ ID NO: 4253283 - RNA, 93 nt, Yersinia pestis
cgcugacgaaacgcuaucaaucagcuauuaagcguuugacgcaaagcaacagcgaagauguuuuccaguugaucaugaacgccuuugcucgcg

SEQ ID NO: 4253284 - RNA, 77 nt, Yersinia pestis
ccccaguuucaucguauuagagcguggcuccaguacggccagaauccgugcuguuccaccgacuuuacugcgcaggg

SEQ ID NO: 4253285 - RNA, 57 nt, Yersinia pestis
aagcccucguaauguaaacugcccaacuuuuugggaucaguucaauuucgagggcuu

SEQ ID NO: 4253286 - RNA, 98 nt, Yersinia pestis
uuuaaucagucuuuagaaggcuuuauuucuuacuauuugauuuuuauauauuauuaaucauguuguagagaaacgaaauccuucgugagcugauuaaa

SEQ ID NO: 4253287 - RNA, 74 nt, Yersinia pestis
guagugaucgagcuacuagcgauaucaucaccagaaaaauuucaucggauagggcuaagaagucuugauacuac

SEQ ID NO: 4253288 - RNA, 76 nt, Yersinia pestis
uugaacgacaugugagugguguaagauacgguccagcaucgcugaggucagugcugcaucaccggcgaacguuuga

SEQ ID NO: 4253289 - RNA, 57 nt, Yersinia pestis
gacacauauuucaggcuguugcguaccauauggaugaugcagagcuggauaugcguc

SEQ ID NO: 4253290 - RNA, 63 nt, Yersinia pestis
ucuggauuuggugauuauugcacuggaugccgauccgccaaccaaugucgcuaaagaaccaga

SEQ ID NO: 4253291 - RNA, 67 nt, Yersinia pestis
gaaccgcagauggcggcggaucugauccgcgacgagcauccacagauuaucgccaccauucugguuc

SEQ ID NO: 4253292 - RNA, 57 nt, Yersinia pestis
gcaugacugaaaggccgaguuuggacuuuaugguccauggaccgguaucagucaugc

SEQ ID NO: 4253293 - RNA, 78 nt, Yersinia pestis
cccguugcagcucuauuccauggguacaccgaauggccaaaaggugacuauucugcuggaagaguugcuggcguuggg

SEQ ID NO: 4253294 - RNA, 56 nt, Yersinia pestis
gguuaguguacuuaacuuugcguggcgaaucacccacgcaguagguuaaauuagcc

SEQ ID NO: 4253295 - RNA, 85 nt, Yersinia pestis
uuuguuuuuuucaagugugguguugaugcagauauuauguugaugcaggcaggguauuugauaauaguacuacaucaagaauaaa

SEQ ID NO: 4253296 - RNA, 69 nt, Yersinia pestis
gcuguuauugguuucguuaucuauguugggguguauagccucuacaugaaacguaaaucagucuacggc

SEQ ID NO: 4253297 - RNA, 113 nt, Yersinia pestis
gccuguucccguuccuguuuauuacuaucgcuuguggugcuaucucuggcuuccaugcucugguauccaguggcaccacaccgaaacugauugaacgcgaaagccauacccgc

SEQ ID NO: 4253298 - RNA, 55 nt, Yersinia pestis
acaggugaaacgcuggggcugaccaaagugaauggucacucacuuauucgccugu

SEQ ID NO: 4253299 - RNA, 63 nt, Yersinia pestis
guugucauccaauuggucgccaccaauaaagcgcacuaaagguuggccgccagugacgacagc

SEQ ID NO: 4253300 - RNA, 78 nt, Yersinia pestis
uauacccaaaauaauucgcguugcaguaaggcagucagggcagcuaacuccccugcagcgugaaggacgauggguaua

SEQ ID NO: 4253301 - RNA, 73 nt, Yersinia pestis
gagcgcguuguucaccguauuacaaccgaagcaauuugcgaugucggguaaagugaacggcgaauuaccgcuu

SEQ ID NO: 4253302 - RNA, 62 nt, Yersinia pestis
uugcguuuucugaguggguugauccauaaaugcuuguaaaucacccgcuuccagaaaaucaa

SEQ ID NO: 4253303 - RNA, 97 nt, Yersinia pestis
cguugagcauuaauagagucuaaaaauaacauaagcuuacggucaccccuuaucagauagucagcuaauuguguuuuuaggcugauaugcaucaaug

SEQ ID NO: 4253304 - RNA, 76 nt, Yersinia pestis
gccucguucagcgcuuucuggguaucugccugaaucagccaguuuaggaacacucuggaggccgccgggugcgggc

SEQ ID NO: 4253305 - RNA, 73 nt, Yersinia pestis
agaaaaaacuggauguugauauuccucauggagaugccugguuccgugaagggagcaagcguccguugguucu

SEQ ID NO: 4253306 - RNA, 63 nt, Yersinia pestis
cagugcgaacaugagcaauggcagacgaaucaaauaaaagucgccgaugugauguuugcaaug

SEQ ID NO: 4253307 - RNA, 76 nt, Yersinia pestis
ggucguuuaugauuuuguuaauguuauucaaggugaugccacuuugaaucaggcauuaaucaaagauaaacguacc

SEQ ID NO: 4253308 - RNA, 63 nt, Yersinia pestis
uuacgugguuaaguccagcgucggucacauucgugauuugccgaccaguggcucagccaguaa

SEQ ID NO: 4253309 - RNA, 83 nt, Yersinia pestis
ggucgcaccaaaaugaccaucaaagaguuacugcgccugucacaaggcucgguggucucccuugaugguuuggcaggcgaacc

SEQ ID NO: 4253310 - RNA, 60 nt, Yersinia pestis
gaugauguucuucaaaacaaaggggcuuggaauacguugcuuugguuugggggcaucauu

SEQ ID NO: 4253311 - RNA, 90 nt, Yersinia pestis
gcuucaaaaaaaugagcuuugacuucugauucagcgaguugcuguucaaguucuuuaauucgcuguucgggaguaagaggcauuuuaggc

SEQ ID NO: 4253312 - RNA, 68 nt, Yersinia pestis
gcaauggauugauacugaucugauugagcugccgccaauaaugucgcaaucggcauuaguucgucugc

SEQ ID NO: 4253313 - RNA, 78 nt, Yersinia pestis
uagcaucguggauauggcugcauuauuaucugauuuucucgcgacaucagauaggcagucagccuuaucauggcgcua

SEQ ID NO: 4253314 - RNA, 62 nt, Yersinia pestis
cauauaucgcuuugggcuugcucccuucugauaaaaaggugagcagcaccaaacgguuauug

SEQ ID NO: 4253315 - RNA, 83 nt, Yersinia pestis
uccccccucaggcuguguauuccgcacccguugcccaauugccgguacggaaugugcgaaaacacguccuuuauuagaaggga

SEQ ID NO: 4253316 - RNA, 56 nt, Yersinia pestis
uugggguuugguaccaccaauauguugcaccgccguaucaagguacaagacccuga

SEQ ID NO: 4253317 - RNA, 87 nt, Yersinia pestis
gcgguuuacggcagcgaucaucagcgguuaauuaauggcgcgacuaggcaccguggcgagacuguugauggcgacuucguuaaucgc

SEQ ID NO: 4253318 - RNA, 84 nt, Yersinia pestis
cagcaguauccgauauucaucuuggauuucagugcuuucuuguucuuuuugcugaaaauauaagcgacaaugucggauuuccug

SEQ ID NO: 4253319 - RNA, 80 nt, Yersinia pestis
cugucagaacuuggauauuauccgccgcuaugacgcagaauauaucgucauucuggcuggggaucauaucuauaagaugg

SEQ ID NO: 4253320 - RNA, 67 nt, Yersinia pestis
acugguugcgcaauaugggauauggguuuacgccauucuauuccugauuuuauucugugaaaccggu

SEQ ID NO: 4253321 - RNA, 73 nt, Yersinia pestis
gacggcugauacuguaucgguacucaccgguugggcgacaaacggucgucgccgaugcguguuaauuuccauc

SEQ ID NO: 4253322 - RNA, 55 nt, Yersinia pestis
uugaggauaaccagcaugucugagugaauaucuccggcaugacucauugcuucaa

SEQ ID NO: 4253323 - RNA, 66 nt, Yersinia pestis
ucagucguggcgugaugaagugauggcgcugaaacagcaacaucacuggcguuaugaccacccugg

SEQ ID NO: 4253324 - RNA, 130 nt, Yersinia pestis
ccgauaacaaagcccagugguagcagggauaacagcgacaguaugaucgcaacaacaacaaccccuguacccggacggugacuauauugucgugcuguugucuuacucagugcagccugugcaacaucgg

SEQ ID NO: 4253325 - RNA, 59 nt, Yersinia pestis
gugaugguggucaucagucggauuaucuuuagcaugaucaugaugauguccacucucgc

SEQ ID NO: 4253326 - RNA, 84 nt, Yersinia pestis
guucugcgcuugauuauuggccucugcaugaugugccaguuuauggugcuggaaagcuggcuuaaugaucaagcggcaucgaac

SEQ ID NO: 4253327 - RNA, 82 nt, Yersinia pestis
ugguuaugcccaagagaagauuuuugaccgcuuuuauucguuaccacgggcuaauagcgucaaaaguacaggguuagggcua

SEQ ID NO: 4253328 - RNA, 103 nt, Yersinia pestis
ggauguuaaauuugcagucaaugucacuggaguugaugguuuuuuacuaagagauagucauguuaccgcaacuuccggugauauuaaugccaaugcuaauacc

SEQ ID NO: 4253329 - RNA, 78 nt, Yersinia pestis
uugguaucaguuaaauucaacguaucuuuaauuuuauagaguucgaaucugaagugugaaguugcaggauacguccaa

SEQ ID NO: 4253330 - RNA, 73 nt, Yersinia pestis
gguugaagaaaugugugcugaaauggucgcuagugacuuagagcaggcuaaacagcaugcauuguuaaaagcu

SEQ ID NO: 4253331 - RNA, 82 nt, Yersinia pestis
cacugacaguacauuauuuggcagcaugucguuccucggugcgaaaauggcuaccgaccaacgcauguggccagugucaaug

SEQ ID NO: 4253332 - RNA, 57 nt, Yersinia pestis
ccaaugaugccauguggcacauuugguugaauauccgccugccacggguguuauugg

SEQ ID NO: 4253333 - RNA, 69 nt, Yersinia pestis
gugccguuuccagcggaauuucaagcugugugagcaccacauugcuuuguuugagcugggauaaggcgc

SEQ ID NO: 4253334 - RNA, 74 nt, Yersinia pestis
gccagcuagcaguuuuuggucacugcgggcguugaauauugcgcuguauugcgccaaugacuguggguuauggc

SEQ ID NO: 4253335 - RNA, 57 nt, Yersinia pestis
ggagcagagggggaauggguaacggggaaaaaucugcggccaaugccgcucggcucc

SEQ ID NO: 4253336 - RNA, 62 nt, Yersinia pestis
cuuacgcauggagaccuccucaggggauauaaucauuaugucagaaggucucuauguaaugg

SEQ ID NO: 4253337 - RNA, 128 nt, Yersinia pestis
gcccgcccgcgaaaggcuuacggucgcaauggcauuggucgccauggcuugcuuuguuuugcugacgaauacgaagugaaaaccuggcgcgauggcauuuuggcaaccuucguuguuggcaccggagc

SEQ ID NO: 4253338 - RNA, 60 nt, Yersinia pestis
uaaccggaucaaaaugauggaagcuuuugcgguaaugcucccguuuuuugagcacgguua

SEQ ID NO: 4253339 - RNA, 113 nt, Yersinia pestis
gcugcucaauauugaucagaaaacguugugcggucucuggcgguggagacucucgcaguaacucagccgccccggagauagcggccagcgggcuuuucaauucaugagucagc

SEQ ID NO: 4253340 - RNA, 74 nt, Yersinia pestis
ggcaccacggucagagauauaaacgacuucgucaucguaaugugcacgggcgauuaucucuagaucggggcgcu

SEQ ID NO: 4253341 - RNA, 64 nt, Yersinia pestis
gcuuucacuugauucaagauacccgcauuacguaccuguggcucuuuacgaucaaguggauagc

SEQ ID NO: 4253342 - RNA, 67 nt, Yersinia pestis
cuggagcacgauauuguccaugcguuacaggcauugccugcacguauugagcagauguuaucucugg

SEQ ID NO: 4253343 - RNA, 102 nt, Yersinia pestis
ggcuaucuuaaauuuaugagaaaugucuagccuuuguuuuccgucuucagucuggcacuggaugcauucaauaaaggcuucauaaaauugguccgguaagcc

SEQ ID NO: 4253344 - RNA, 77 nt, Yersinia pestis
ccaccacgagcaaaauaucuucaaaaugggcggucugcguaagaccauuccauuggucuauaucugcuuccuggugg

SEQ ID NO: 4253345 - RNA, 61 nt, Yersinia pestis
ggcgguuaucugcacuguggccacaugagauuucaggugggcagcagcagcggguggcccu

SEQ ID NO: 4253346 - RNA, 72 nt, Yersinia pestis
gaacgacaugugagugguguaagauacgguccagcaucgcugaggucagugcugcaucaccggcgaacguuu

SEQ ID NO: 4253347 - RNA, 80 nt, Yersinia pestis
cucccacaccccgaugaugcagcaguaucuucgguuaaaagcccagcauccugaaauacuccuguucuaucgaauggggg

SEQ ID NO: 4253348 - RNA, 106 nt, Yersinia pestis
cgccaucuaaucccagcgccuuuaauucaguauauucaucuucugccaauggcugaaccuccaucauuagcgaacugaaucuacugcggaucguagggagguggcg

SEQ ID NO: 4253349 - RNA, 57 nt, Yersinia pestis
aaaaaagcccggucacucaauuggacuaaccccaauauugaguaaccgggcuuuuuu

SEQ ID NO: 4253350 - RNA, 74 nt, Yersinia pestis
gcuguuucaaugugacuucaacaugccgcugcugcauccaguuacgcaguuuuaguguggagucgccaaacagc

SEQ ID NO: 4253351 - RNA, 78 nt, Yersinia pestis
ucuucuucuauauagaaggcagcuugcugguggcuguuuucaccguaacgcauauccugcuucuuuauauaguuaaga

SEQ ID NO: 4253352 - RNA, 55 nt, Yersinia pestis; identical to SEQ ID NO: 4227370

SEQ ID NO: 4253353 - RNA, 74 nt, Yersinia pestis
ucacucaagauuugcaacucagcguaauguuauggcgcauaauuuauuuacuugguugaaugaaucggggguga

SEQ ID NO: 4253354 - RNA, 81 nt, Yersinia pestis
acgguuggaaugcccauggcccguuaauuaccgcagccgcuuuuuucucagugaauaaugagucaauagcauucaagccgu

SEQ ID NO: 4253355 - RNA, 75 nt, Yersinia pestis
cgguuggcggggcggcauuagcgcaauuggucgauauugaucucagccaguuggaugaucgccuggcacaaaccg

SEQ ID NO: 4253356 - RNA, 59 nt, Yersinia pestis
uacaggcucuaaucguauuguguccaauccuucagcuucacagaauuuuuagggccgua

SEQ ID NO: 4253357 - RNA, 125 nt, Yersinia pestis
gcggcaaugcacugcgccucagucauccguaugucacacaguggguuauugauugccuaaauuauuggcgcgauagcugccauguggacggcuuucguuuugacuuaggcacgguacugggccgc

SEQ ID NO: 4253358 - RNA, 58 nt, Yersinia pestis
acaaggucugaaugccgauauggucuauuaugaucgugucaguaaauaagacccuugu

SEQ ID NO: 4253359 - RNA, 60 nt, Yersinia pestis
acgauuuguuaugcuuuuaugcaggccagcggcuuggugaacgaucacauggcaaauugu

SEQ ID NO: 4253360 - RNA, 76 nt, Yersinia pestis
ucaccaucccgguaauguauggcggugaagucggucccgaucuggcugacguugcccgucauacggggaugaguga

SEQ ID NO: 4253361 - RNA, 93 nt, Yersinia pestis
ggccaaacguauugguaacgcagaaauauucagagaggcgaucacuugcuccucacuguuugcuuucugaaauauuaaugcuuccccuuggcc

SEQ ID NO: 4253362 - RNA, 122 nt, Yersinia pestis
ccggcaucgagucagugcgugaaauucugucuaagugugucuuugaugaagagaaaugcgcugaaggcauuacucaucuggaaggcuaccgaaaagagugggaugacaagcgcggcugcugg

SEQ ID NO: 4253363 - RNA, 55 nt, Yersinia pestis
gcucguuuaucucggcaauuacaacggccuguuaaugucaccgaauugaaugggc

SEQ ID NO: 4253364 - RNA, 58 nt, Yersinia pestis
gccaagguaucgccuugcuaaagauuagcaaguacuacucagccgaugaccuugcggc

SEQ ID NO: 4253365 - RNA, 77 nt, Yersinia pestis
uucacgguaacagcugcuggccacugcguaauccaacaccaggggagucaccaaugggcagcgcuguuacuugugaa

SEQ ID NO: 4253366 - RNA, 103 nt, Yersinia pestis
acccgucagacuucaagugaccuguagguuagcuguucucgugcuauucgaauuauuuugaacauaggguggcggcuaaaaaaggaauuugaauaugaaaggu

SEQ ID NO: 4253367 - RNA, 61 nt, Yersinia pestis
ggccgaugcugauauuuuuguaauuauugcaguagaguugcaaaagaaaucaggauugacu

SEQ ID NO: 4253368 - RNA, 96 nt, Yersinia pestis
auuaugcgccauaacauuacgcugaguugcaaaucuugagugauugaugucuuguaacucaagucguuggcucagugacuguagggcuugcguaau

SEQ ID NO: 4253369 - RNA, 76 nt, Yersinia pestis
guggguauugucguugauauugucguugauauugucguugauauugucguugauauugucgcaaggcaguaaacac

SEQ ID NO: 4253370 - RNA, 78 nt, Yersinia pestis
guuuuauuuacugcaucauguuugcugauugcaacgaccuugauuguaaucuuguggcuaauaugaugggacgaagac

SEQ ID NO: 4253371 - RNA, 64 nt, Yersinia pestis
gcacgcggcgaauucuaccuauaagauuuaucuuacucaaucuuaauaggucaguucgcgcggu

SEQ ID NO: 4253372 - RNA, 55 nt, Yersinia pestis
gagguuuccugauuauaguauuggcucacuccuugauuauaacuguaggaaccuc

SEQ ID NO: 4253373 - RNA, 59 nt, Yersinia pestis
gauccgccgguggucagcggaauauauaccggguauuuuccgccccgagcugguggauc

SEQ ID NO: 4253374 - RNA, 69 nt, Yersinia pestis
cagcgguugaugcgcuggagcgccagaauguacgccguaucuuacugacgcguccagccguugaagcug

SEQ ID NO: 4253375 - RNA, 80 nt, Yersinia pestis
cucuacucaacgguguuccgcgaauaucugggugagcuauuuacucguggcuauuccguugaauacuuuguugaaggggg

SEQ ID NO: 4253376 - RNA, 57 nt, Yersinia pestis
uccuuggguggaauggguuuauaugccaugaaagguagcgaauuuccgcuccaggga

SEQ ID NO: 4253377 - RNA, 70 nt, Yersinia pestis
ugugaggccgaaauuugacguacuucugcggugguacgcccuucaauuugcucaaguaucagugcucgca

SEQ ID NO: 4253378 - RNA, 77 nt, Yersinia pestis
gugauuauguggcgguuauuaaguggcugguuugcucucgcgauccuugucacgguuagcuguuauauuuuauucac

SEQ ID NO: 4253379 - RNA, 61 nt, Yersinia pestis
gaauuucauagcgaugcugaugaugggaggcgaaaaccugaauagcauugccaugaaguuc

SEQ ID NO: 4253380 - RNA, 61 nt, Yersinia pestis
aagccguauuaacugaauaccaggcccacagcaaacaggauauuggucaguaaagcggcuu

SEQ ID NO: 4253381 - RNA, 56 nt, Yersinia pestis
caguguuguuugguuuagggcugucuucauugccaaaagaaaccaaagaaccacug

SEQ ID NO: 4253382 - RNA, 125 nt, Yersinia pestis
ugcagcuaacgcauucaccucugcauaaguacugguauaggccugaaaauaagccagguaacgauucgcucgauuggcuuuuuuggccuguaucgcgaguugcugagugauacuuuguugcugca

SEQ ID NO: 4253383 - RNA, 72 nt, Yersinia pestis
acccaguuucuguugaguggaaccaucauagguuugauaaccguuugaacccaacccagcagaaaguguggu

SEQ ID NO: 4253384 - RNA, 106 nt, Yersinia pestis
gguuggugaauacgagaugggccagcacuggauaaauccgugccaugggaaucgauuguaucgauuugcugcuugguuacggguuuauccauaacaucugccaacc

SEQ ID NO: 4253385 - RNA, 108 nt, Yersinia pestis
cugcggugauucuagguuuggcauuucaugauguuaucaaggcgcuauuugacccaaaaagugucauguaugccuugguggcgggugggguguuauugcuggccgcag

SEQ ID NO: 4253386 - RNA, 71 nt, Yersinia pestis
gggcuuugaguucgccuugaucaucaaauaacaagcuacugcuggugaucagguccggugacucacggcuc

SEQ ID NO: 4253387 - RNA, 67 nt, Yersinia pestis
gaucucaguacggaucgcauccgugaugaaaaaguaaaaguacugcguucgcugcgccguauugauc

SEQ ID NO: 4253388 - RNA, 81 nt, Yersinia pestis
gccgcgcggacgaucagguuuugcucauuuuccaccccugcuauggggguuaauaagcgaauuugguugucaucgcgcggu

SEQ ID NO: 4253389 - RNA, 66 nt, Yersinia pestis
ggugcaguugcgaccaucacccugacugcgccaguuaauggcgcgguggcggauggugcagacacc

SEQ ID NO: 4253390 - RNA, 99 nt, Yersinia pestis
ggguuccaagggggccacgcuuugcacugaaccccagaucuuggaucuuuuuauccaugaucuggagguucgguucaaugaaacacccuuuuucaaccc

SEQ ID NO: 4253391 - RNA, 65 nt, Yersinia pestis
cguaauacguugaucccggaugugcgggcacuuuuuucauucccgcccaccgcguagacguaacg

SEQ ID NO: 4253392 - RNA, 60 nt, Yersinia pestis
acuuguccagcuaagggguauucccaugcaauugcguaaaacacucuuaguaggacuggu

SEQ ID NO: 4253393 - RNA, 63 nt, Yersinia pestis
cggauucaucgacaacaucaucguguagcagugucgccguauggauaaacucgaugagugccg

SEQ ID NO: 4253394 - RNA, 62 nt, Yersinia pestis
guauggcgguguccaccagcaguacuuaacacgccgagaaucugcagugaaugaccgccuac

SEQ ID NO: 4253395 - RNA, 68 nt, Yersinia pestis
agauaaccggugugguguuagccacggccagaauaccggcagugccuggugucauagccgauuuaucu

SEQ ID NO: 4253396 - RNA, 60 nt, Yersinia pestis
acggucugugccaagcgggcagacgggcgaccuggugucggugucgcgcucgcaggccgu

SEQ ID NO: 4253397 - RNA, 60 nt, Yersinia pestis
guguucgagguggcgauaaagagugaaauauaccguuaccucuauuguuacuuuuaauac

SEQ ID NO: 4253398 - RNA, 69 nt, Yersinia pestis
gguauugguuugaucgauagccgggcgcuaguugaugugauugaugccguugaauugaucagacccgcc

SEQ ID NO: 4253399 - RNA, 130 nt, Yersinia pestis
ucuccguaucccguguggguggugcagcgcagaccaagaucaugaaaaaacuguccggugguauucguaccgcucuggcacaguaucgugagcuugcagcguucucccaguucgcauccgauuuggauga

SEQ ID NO: 4253400 - RNA, 73 nt, Yersinia pestis
gggcaaauaaugcgccucauuccaugucauaaacgaaacgaggcuggacugaugagccgcuuauuuaauuucc

SEQ ID NO: 4253401 - RNA, 89 nt, Yersinia pestis
aguaaagacuuccggcucguggugcaucuacugcgcacccuacaacacgggggccagccagaugaauuaaugcuggcgaugucguugcu

SEQ ID NO: 4253402 - RNA, 64 nt, Yersinia pestis
ggcguauuaacauuggcuggugggauuuucuuagugucguucaccacguggaugaaaaaacgcc

SEQ ID NO: 4253403 - RNA, 87 nt, Yersinia pestis
ggcagcaccgaaugcugaagcuuugugggauaccguaucagaaguugaugcuaaauuuaucagcaaagaugccuuugguggcgagcc

SEQ ID NO: 4253404 - RNA, 64 nt, Yersinia pestis
cacguaauggcagaagccggugguuccgucuuugcuaacaugccauugauuuuugcuauuggug

SEQ ID NO: 4253405 - RNA, 55 nt, Yersinia pestis
aucgaaaugguagucaaacaaugaaucagguuuacguuugaucaccaguuucggu

SEQ ID NO: 4253406 - RNA, 120 nt, Yersinia pestis
uugcugcguuaauguauguugcagcgacucauugacacugagcaacugcugcugguuaaucuguaaauugauugccagugucaauugguuacccaguugcuuauuuaauugauccaguag

SEQ ID NO: 4253407 - RNA, 67 nt, Yersinia pestis
uuggguguuaucugguccgcuagugugggcuucaacagacuacucacuguggguuaaugauauucaa

SEQ ID NO: 4253408 - RNA, 83 nt, Yersinia pestis
cauuuuuucuggcaaugucguuaauucaaaguaaugcgucgcaaauagcgucauugcuuugauacggcuggccagauuuucug

SEQ ID NO: 4253409 - RNA, 78 nt, Yersinia pestis
cgcaacaguuggcaggccagucaaggggucuaugauuucucacaugaagucaaagaauccaugucuggcugucuggcg

SEQ ID NO: 4253410 - RNA, 88 nt, Yersinia pestis
uugcccguacaggcaaguuauuugccauggaauauuaucccgacaccaaaguugaugugaucaccauggcgaaaagccuugggggcgg

SEQ ID NO: 4253411 - RNA, 77 nt, Yersinia pestis
auuuuuccccaacagugcugaauccgggaucagcgaaaccuccgccauccccacauugcgggauuguucagagaaau

SEQ ID NO: 4253412 - RNA, 81 nt, Yersinia pestis
cgagcagcaccgcuaauaucuuggcuucacuggucuuuaucacaacccuguuaggccggccaauuggcgcuuuacuguuug

SEQ ID NO: 4253413 - RNA, 79 nt, Yersinia pestis
gauggagaguggaugaugcaggggguguuugucgaaguucaccagauuuucaucaagaugcacgucauacucuuuuuuc

SEQ ID NO: 4253414 - RNA, 83 nt, Yersinia pestis
cggggcgauaagcagcgacaggagaaggguuacgccaauuucuguaauucuuuacgugcugcuucggcuagaaaauugcuucg

SEQ ID NO: 4253415 - RNA, 117 nt, Yersinia pestis
caugaaggccucacccgugagcagcaugaucaacaguugauugagaaaauugaacaauaucaaccagauuauguuguucuggcuaaauauaugcgggugcuaacaccggccuuugug

SEQ ID NO: 4253416 - RNA, 108 nt, Yersinia pestis
ugcccacgccaucaaccaagcaggcucauugcguaugcagagcuacagguuacuuucaaugaucccuuuggauagcaaugaguuaucuuaucugguggcauuggagca

SEQ ID NO: 4253417 - RNA, 75 nt, Yersinia pestis
guuuaucuaucgccuugucgguugguuuugaacacuucgaacaacugcucaguggcgcacaugccauggauaagc

SEQ ID NO: 4253418 - RNA, 60 nt, Yersinia pestis
aaaguggccagagaucuguuuacuguauugcaagacagugaggcaggaaaucggcucuuu

SEQ ID NO: 4253419 - RNA, 60 nt, Yersinia pestis
acgccugacaaauguacucaaagcuuuccgaaugagguuccugagagguuuuguaggcgu

SEQ ID NO: 4253420 - RNA, 69 nt, Yersinia pestis
auaauccucauguugacgaauaauuucauuggccucugcuaauaauuuacuacguucaauagggguugu

SEQ ID NO: 4253421 - RNA, 61 nt, Yersinia pestis
aagugcugcuugagaacuuacuacgccacuuggauggggugcaaguucaggaagcggauuu

SEQ ID NO: 4253422 - RNA, 63 nt, Yersinia pestis
gcaaguggcuaucggcggcaagcgguuguaauugcccugcuuuuaucguugguagccaccagc

SEQ ID NO: 4253423 - RNA, 62 nt, Yersinia pestis
gcugcaaugguuccgauuuucauuuuacaauuaaaaggacuugggaucauugucucacaagc

SEQ ID NO: 4253424 - RNA, 83 nt, Yersinia pestis
caauuaccacaacgaauuucgauacgaugcauauuaugagaauaaucaucaauauagcguauugaaucagcgucaauggguug

SEQ ID NO: 4253425 - RNA, 64 nt, Yersinia pestis
guugauugccauucuggggcugguauuugugcacuucaaugccaccgguauuuggacauucaac

SEQ ID NO: 4253426 - RNA, 55 nt, Yersinia pestis
uacguucgcggaucaccgguuccagacuccggaauuguucugguaagcgaaugua

SEQ ID NO: 4253427 - RNA, 73 nt, Yersinia pestis
ucgagguuauugcguagaaauggauguuaaaacgggaauguaauuagcucgacguuaucugccguaacuuuga

SEQ ID NO: 4253428 - RNA, 72 nt, Yersinia pestis
guucaacuggaagauccgcuggggauggaaguggguuaccgcuugauaccgaugguggauuuccagcaaaac

SEQ ID NO: 4253429 - RNA, 80 nt, Yersinia pestis
guuugaguuugguauuuuugaauggcaugcggaugguuccucuaccgcagucaaauaacaagaauaguagaacuauugac

SEQ ID NO: 4253430 - RNA, 79 nt, Yersinia pestis
gcuggcagcccgauaccauaaaaccggaugucggcaguaacgaugccauucugguuuaucugugggcggggaugcuggc

SEQ ID NO: 4253431 - RNA, 72 nt, Yersinia pestis
uggccaugguugaucaaauuuuuguuacgacguugaaugaugguagccuuccauuugaucccgucauuacca

SEQ ID NO: 4253432 - RNA, 67 nt, Yersinia pestis
gcacgaagcgguaacccgcauucaccccaagggugccuaucaucgagcgggugcugcugcuuugcgc

SEQ ID NO: 4253433 - RNA, 79 nt, Yersinia pestis
gcgauuuccgccgccgggaugagaaaccgaugcucacccgcuccgcauggcaggagguucucguucaggccggguuugc

SEQ ID NO: 4253434 - RNA, 58 nt, Yersinia pestis
ugaauuucacaucacgacauuuacauccucugcggucaauguagugaugcugaauuua

SEQ ID NO: 4253435 - RNA, 82 nt, Yersinia pestis
uuucgccaucgagguguauugcgcuuuuguuagcggguacaugauaccgcgcacgauaaagguaauaacgaugauggagaag

SEQ ID NO: 4253436 - RNA, 63 nt, Yersinia pestis
gacgauuccugucaacuuuugcugacagacugcuucaucaguaagaggggacaggguauuauc

SEQ ID NO: 4253437 - RNA, 77 nt, Yersinia pestis
cgacauacccgccauuugugcugaagcuggguucguuccaugggcugaacuugggaucagacagauauggcgguucg

SEQ ID NO: 4253438 - RNA, 58 nt, Yersinia pestis
uuggauucaacggcccaguuagccgguaauucaccgcugacacgacguuugaauucag

SEQ ID NO: 4253439 - RNA, 85 nt, Yersinia pestis
cugggagcaugggaacaguauugggacaguauuuguagaagcggugucugcggggagagugucagugcgguuaccccacucacag

SEQ ID NO: 4253440 - RNA, 70 nt, Yersinia pestis
gagaguggaugaugcaggggguguuugucgaaguucaccagauuuucaucaagaugcacgucauacucuu

SEQ ID NO: 4253441 - RNA, 72 nt, Yersinia pestis
gugaauuauuaucgcuuuggaugccaguaacaccugaaauagcguggguguucagaaugauaguugaaucau

SEQ ID NO: 4253442 - RNA, 66 nt, Yersinia pestis
gauguaaaauugaucacuguacuccugcuggcacugacggcagagcagucauuaaauuuuaucauc

SEQ ID NO: 4253443 - RNA, 70 nt, Yersinia pestis
ggcugagaugaaagguuggucugaaaaaggcguugaaugugauuuagcgcugaucggaucaaaagcagcc

SEQ ID NO: 4253444 - RNA, 79 nt, Yersinia pestis
gaagauuggaaaacccuggaucugggccgccauggcaauuacagcaagcaacgugacccacagguuuuuacccauccuc

SEQ ID NO: 4253445 - RNA, 74 nt, Yersinia pestis
cuuagacgccgucacaauguaaacguugcaacaauuuaaauguuguaacaauuuaaaugugguagccauuuaag

SEQ ID NO: 4253446 - RNA, 84 nt, Yersinia pestis
auaacagaacgacagaaaaacagcggcuaaucauagcucaccauacuuacuuugagaaugccguuguguuuucugugggguuau

SEQ ID NO: 4253447 - RNA, 87 nt, Yersinia pestis
guuaugcuugccgcuucaauuugauuagugacuaaaggaaaauucaugacaaccccuucuuuugauagcguugaagcgcaagcgagc

SEQ ID NO: 4253448 - RNA, 115 nt, Yersinia pestis
guaacuguauaagaacgcgcugugaguggcaggcguguugguggcuaccugaugaugagcaaagguacccaauaauauuccggcaguacugaccccgauacucauggacaguugc

SEQ ID NO: 4253449 - RNA, 61 nt, Yersinia pestis
auugaauccaugcuaaaccgguggguaagccccuaaaaaaccaagguuuaugguuuucaau

SEQ ID NO: 4253450 - RNA, 69 nt, Yersinia pestis
ucaucgggguuugucagcagucugaaaggcccuacggggccuuuuuucguugcugacaauccaauauga

SEQ ID NO: 4253451 - RNA, 71 nt, Yersinia pestis
gauggugcgacaggcucggcguuagccguuguucgguuaaccggccaaucuugucguagcugaacgccauc

SEQ ID NO: 4253452 - RNA, 64 nt, Yersinia pestis
ggccauuggcagcuuuauauauucugccugcgggaaaaucucgcugaagccuugcucaauggcc

SEQ ID NO: 4253453 - RNA, 79 nt, Yersinia pestis
gaucuuauuuucgucuuguacugguuugcggugcgucacugucacguuacggcacucuugacgaggcguuuugaugguc

SEQ ID NO: 4253454 - RNA, 86 nt, Yersinia pestis
gguguacuggagaauaaauacuggccaaccguaaagcgucuggaugauguuuacggugaucggaauuuguucuguucaugugugcc

SEQ ID NO: 4253455 - RNA, 57 nt, Yersinia pestis
auuggcuagccaugcuguccuuugauacccaccaacucagcgucuggguuagccaau

SEQ ID NO: 4253456 - RNA, 58 nt, Yersinia pestis
ucauccaucugucgcccggucauuaaauagccuaauugagacugggugaaauggguga

SEQ ID NO: 4253457 - RNA, 108 nt, Yersinia pestis
ccuuguccgugcgucaucgaccacaugggacauaugccugugucauugggacucaaucacccaggcuaucagacauuguugcauauggucagagaauauggauggugg

SEQ ID NO: 4253458 - RNA, 79 nt, Yersinia pestis
uguacgacucguuauguugaaaaggccgcugcgaaaaucgaaucccgcagcggccucuuuagcauaacgucauugugcg

SEQ ID NO: 4253459 - RNA, 74 nt, Yersinia pestis
gacuggaucaguuucucuuuaaccucgaccggugucauuucaauuuguauugguuugagcagaaauugaauguc

SEQ ID NO: 4253460 - RNA, 85 nt, Yersinia pestis
ucgacaaacgccgcccacgcgcuaacguuucucaggugaugcauaucaucggggacguugcuggccgugacugcguguuaguuga

SEQ ID NO: 4253461 - RNA, 67 nt, Yersinia pestis
aaucaaucuaaugguuguuaauuaagauuaagccaugggucauuaauuaagcuauugguuauugauu

SEQ ID NO: 4253462 - RNA, 81 nt, Yersinia pestis
agcuuacaacuuauuuuaaguggcgaagagagccagcgcagugagcguauuuuggcuuauuucaguuaccugaaugaagcu

SEQ ID NO: 4253463 - RNA, 118 nt, Yersinia pestis
uuauagguaacuaauuuucgaugguugauaguagauaacugauaguagguaacagauuauagguaacugauuauagauggcugcuagucaaucgcggaucguaaauagcuaacuguaa

SEQ ID NO: 4253464 - RNA, 60 nt, Yersinia pestis
gcgagugaucaccgcguugugucauggggccuuuuuugguaucggcgcgguggucgccgc

SEQ ID NO: 4253465 - RNA, 128 nt, Yersinia pestis
accauucucaauuucauuggcucaucaccuauugccauguuuaucgccauguugguugccuucguacuuuucggcaccggacgcggucauaaaauggaaugggucaugcacucauuugaaggggcggu

SEQ ID NO: 4253466 - RNA, 73 nt, Yersinia pestis
gcccggugcuggaagguuaauugauggggucagccgcaaggcgaagcucuugaucgaagccccaguaaacggc

SEQ ID NO: 4253467 - RNA, 70 nt, Yersinia pestis
aaugcgcugaauuacuccguugguuuccgcgccccaaguggucgagaacuggucagugguuuugcggauu

SEQ ID NO: 4253468 - RNA, 62 nt, Yersinia pestis
aggaucaucagcuagccacugguacgaacucagauccaucaacccuuggcuaugguaauccu

SEQ ID NO: 4253469 - RNA, 72 nt, Yersinia pestis
uggaaacacucauaaugguaaauucauaauccacaucgccagcagaguggauuuugccguuagugccaacca

SEQ ID NO: 4253470 - RNA, 98 nt, Yersinia pestis
acgucggguugcagagguucuggaugggagcgagagugcaucguaucagcagguuugcgaugaacuugucgccucguuugaugauccugaacugacgu

SEQ ID NO: 4253471 - RNA, 96 nt, Yersinia pestis
ugcguugaaucaugccucaaucauugauggcguacgguuauguaaagccaagcguuaucguuaugccaacaaugauaugacagagcuggaagcgca

SEQ ID NO: 4253472 - RNA, 56 nt, Yersinia pestis
cgauugguugguaccgccaggguugacaauaacuuugacguuuugacgaucaaucg

SEQ ID NO: 4253473 - RNA, 56 nt, Yersinia pestis
aguuguugugcucuugagccucgcgcagacguucuugcucuucggcaauaacagcu

SEQ ID NO: 4253474 - RNA, 79 nt, Yersinia pestis
ugugcgagugauucaaguugugccaacguaccgaucagcaccugcugguccacacggguuccacggccaaucacugcca

SEQ ID NO: 4253475 - RNA, 61 nt, Yersinia pestis
ccucucgcaaagcgaugaucacggcagaaguucgucugucugaacuugcuuuaguggaagg

SEQ ID NO: 4253476 - RNA, 55 nt, Yersinia pestis
acaucgguaaucaguuugcuccaccccaugguggcaucaagcacguuauugcugu

SEQ ID NO: 4253477 - RNA, 126 nt, Yersinia pestis
cuauuucuaucagaaauguuucacccgugaugguaguaaacuguuguucgguggugcuuuugauggcccauggaauuacuauuuacuggaucuuaacagccgggucgcaacacaacugacugaagg

SEQ ID NO: 4253478 - RNA, 62 nt, Yersinia pestis
agucgccgcaaccggugauggcccggacauuaucuucugggcccaugaccguuuugguggcu

SEQ ID NO: 4253479 - RNA, 61 nt, Yersinia pestis
gucaguuuccugcucuguuccagaccacuagaaaugggggggauuuggcggggagacugac

SEQ ID NO: 4253480 - RNA, 59 nt, Yersinia pestis
gugccuauuggugauggcgcaccgauugcugugcaaucaaugaccaauaccaaaaccac

SEQ ID NO: 4253481 - RNA, 59 nt, Yersinia pestis
ucugguuuuuucacugauggauuaugcuuuucagcgcuacaccaucaugaaacaacuga

SEQ ID NO: 4253482 - RNA, 61 nt, Yersinia pestis
agcaagguguucuggcucaccaaugcgauacgcugccaggugacagcggcucaccucugcu

SEQ ID NO: 4253483 - RNA, 57 nt, Yersinia pestis
ccguucaucacgauaaagucagguucaaaccgagccaguucuucaucugauggacgg

SEQ ID NO: 4253484 - RNA, 104 nt, Yersinia pestis
uaugacguaggcccauacuuuugugguaacccguaucaugagaaucuaaccagcguuuuuucgcggcgugaugggucuccgcagaguguuuuccugacaucaua

SEQ ID NO: 4253485 - RNA, 57 nt, Yersinia pestis
uggcgauugccaguggugugccaccgcaauacggcuuguauacuucggcuaucgccg

SEQ ID NO: 4253486 - RNA, 55 nt, Yersinia pestis
auucgauuuaucuggcuuuaaucuggugauccaugaagcugcccauaaauuggau

SEQ ID NO: 4253487 - RNA, 80 nt, Yersinia pestis
aucguuucggccauggugcuuucgguucugguggcauuaauucugacaccagcacugugugcgaccaugcuaaaaccgau

SEQ ID NO: 4253488 - RNA, 78 nt, Yersinia pestis
uacccaaucaaggccacugucagcugaacugaccccauaaaguuggacgguuuaucagcaacaguggcuuuuugugua

SEQ ID NO: 4253489 - RNA, 77 nt, Yersinia pestis
gcauuaauaucaccggaaguugcgguaacaugacuaucucuuaguaaaaaaccaucaacuccagugacauugacugc

SEQ ID NO: 4253490 - RNA, 56 nt, Yersinia pestis
acgcuguuggagaagauguugaaauaauacuuuuuuaaagcuuuauucaauggcgu

SEQ ID NO: 4253491 - RNA, 108 nt, Yersinia pestis
gugguucauuaucacccacaggguauugauguugguuggaaggcgcgcaaucuggcggccuuggacccgguuaauaccaucaguucagugaaacgcaugaugggccgc

SEQ ID NO: 4253492 - RNA, 68 nt, Yersinia pestis
cgguuggcugccagcacuguuuauccugauaaaauuuuagaggguauucgccuuuggucagugagcug

SEQ ID NO: 4253493 - RNA, 63 nt, Yersinia pestis
ugauugggugauuugagucggugaucggguucgguugauauucguucagugaucaccuaauca

SEQ ID NO: 4253494 - RNA, 64 nt, Yersinia pestis
caugccuuaccacguuuaccguaacccaugcgauuacgcugauggcggacagugguauaacgug

SEQ ID NO: 4253495 - RNA, 60 nt, Yersinia pestis
gaucguuugaaaucaacgucacgggguuaugcuucacuggauuauaauuucaaacgcuuc

SEQ ID NO: 4253496 - RNA, 88 nt, Yersinia pestis
agaugugccaaaagaagaugugaucaucaaaagcgucacuauuagcgaguaaugacggcuuaaugagcacgcuuuuuauugcagaucu

SEQ ID NO: 4253497 - RNA, 79 nt, Yersinia pestis
gcacagagcgggaacgccaaguaugcaggcccugguugcagcacgccaguguucauauucaugguuucaaaauccgugc

SEQ ID NO: 4253498 - RNA, 72 nt, Yersinia pestis
uuagacacacacuggcggugucucauuaauacccguaacggcguauuauugagaacgcuccagccauucugg

SEQ ID NO: 4253499 - RNA, 61 nt, Yersinia pestis
acguuucuuucaagaaagcacguaaucccucucggauuucguacuuuacguaaagaaacgu

SEQ ID NO: 4253500 - RNA, 117 nt, Yersinia pestis
gaacagggccugauacauggcgucggaggcaguaagaauaggcugcucaugguagagggugucuuguaauguaggagcgauguuuucugucacgccaaguagaaagaugcccuguuc

SEQ ID NO: 4253501 - RNA, 71 nt, Yersinia pestis
gcgaauaauccgguaguaaaaaccggucuggcguuaaaagaugccaaagaucagcuauccggguugaaagc

SEQ ID NO: 4253502 - RNA, 79 nt, Yersinia pestis
caagccagugcauucuucaguggccgugaugaaauaaccccuauugaucugauuuuacugaaagauugccuauggcaug

SEQ ID NO: 4253503 - RNA, 109 nt, Yersinia pestis
uauauauacauucguuaauaccgcauuacuaauacucauugccuguacgauugucacaccauuagaauguaguguuguuaauguucuaagauaacgagauguauuuaua

SEQ ID NO: 4253504 - RNA, 67 nt, Yersinia pestis
gcuuauucugugccgcagcuagccuauuaaccgaagaggugaugguugugcuguggauagcuggagc

SEQ ID NO: 4253505 - RNA, 56 nt, Yersinia pestis
cgguuaagcgguugacugagauguugcguaaauaucagagugcgcugauuuaaccg

SEQ ID NO: 4253506 - RNA, 96 nt, Yersinia pestis
cuuagcaccaucccacuccagcaacuggcguuucggaucccacgguuuacccugcgggucagcagacgcacgguuguacagaaugcggcgguuaag

SEQ ID NO: 4253507 - RNA, 67 nt, Yersinia pestis
gccgagagugguuucauugacggcugucgggguugagcccugagccgcguuggcaucacucaccggu

SEQ ID NO: 4253508 - RNA, 61 nt, Yersinia pestis
guagagccgauuaugcuggagcagaucagccguaucucgcagcaaauugguuauuaccugc

SEQ ID NO: 4253509 - RNA, 87 nt, Yersinia pestis
uaggucacuacgcugauuuuauuggguguauuauuaauuuuacgucacuguaaaguuggcacuacucuuaauuaucgguaugauuug

SEQ ID NO: 4253510 - RNA, 57 nt, Yersinia pestis
agaaaaaauguuuauggggugaggcugagaaauaaccucaccauuaacguuuauucu

SEQ ID NO: 4253511 - RNA, 84 nt, Yersinia pestis
acucgaucauuaacuuucaugcuauuacccuuaguuaaaucaaugcggcuaguguaguacaaaaugaggggcgaaugauaaggu

SEQ ID NO: 4253512 - RNA, 109 nt, Yersinia pestis
uuaugaguuauguucugacccuauuuuuuuagcuacugcuaacucauugauuuuacauugugguuaucgguggucuaaaaaaaggguuuuuuccccauuagcgaaauaa

SEQ ID NO: 4253513 - RNA, 55 nt, Yersinia pestis
gacagauggucagggagucgguggagaucuacaacacccggcguccucaucuguc

SEQ ID NO: 4253514 - RNA, 56 nt, Yersinia pestis
uugcguaauaaugcggcuuggugucacgaaaaggcggccaaggugcuuuuacgcga

SEQ ID NO: 4253515 - RNA, 60 nt, Yersinia pestis
agcgauauuaccaccauauuuaacaucgacaguguuggugguugugguggugguuucacu

SEQ ID NO: 4253516 - RNA, 62 nt, Yersinia pestis
cggcagcuauguaaacgacuuuaucgaccgaggucgugugaagaaaguuuauguacaagccg

SEQ ID NO: 4253517 - RNA, 59 nt, Yersinia pestis
gccgauguggguauguugggccuaccuaaugccgguaaaucgacauuuauccgcgcggu

SEQ ID NO: 4253518 - RNA, 58 nt, Yersinia pestis
cuguuuguguuggaucugauuuacgccuuauuggucaaagcugauccggcgcaggcgg

SEQ ID NO: 4253519 - RNA, 61 nt, Yersinia pestis
ggaugcgguugcugcccugaaagcaacacaugacgcugcggucaaggcagaagccacauuc

SEQ ID NO: 4253520 - RNA, 67 nt, Yersinia pestis
acucuacguaaggauugccgcguaauuuacaaaucguuguugcgcuuucaauaccuuugaaaagagu

SEQ ID NO: 4253521 - RNA, 108 nt, Yersinia pestis
aauuuguauugaugaauacauuaauguauuggagcaauaucuuggaacuucaucaguaaaacuuagagaagcccuagcauaugcuucugauuauuuaucagaugaauu

SEQ ID NO: 4253522 - RNA, 63 nt, Yersinia pestis
cauuugauuuuggugacgucugagggccguaucauuggcguacagcgucaagaagugcaaaug

SEQ ID NO: 4253523 - RNA, 63 nt, Yersinia pestis
gaguucugccgaagagagcuaucaggccaaauuuagccugauaccgauuaucuucgguaccuu

SEQ ID NO: 4253524 - RNA, 66 nt, Yersinia pestis
gccagcuugucggucaguguuuuaaccuguugcucaaggucggguacacgaacgcgcaggcuuggc

SEQ ID NO: 4253525 - RNA, 70 nt, Yersinia pestis
ccaacguaaucaucaacugcuuggcauacgggcaacauugaccgagccaacgguugauggcuauggccgg

SEQ ID NO: 4253526 - RNA, 100 nt, Yersinia pestis
cguuaauggccgccuaaaaggugcucauaucgugauggauaaagucagcgugggugcgacggugacuaucaugagugcggcaacacuggcggaagggacg

SEQ ID NO: 4253527 - RNA, 92 nt, Yersinia pestis
cauacaauuuacgugccagugccagauccccagccuucacugcaucggugaacgcuuugguuuggcugacuaacugagccacuucuugugug

SEQ ID NO: 4253528 - RNA, 58 nt, Yersinia pestis
cugaccuaugcucagguggguuguauucuuaaauauacuaagcccgcuuauuggucag

SEQ ID NO: 4253529 - RNA, 58 nt, Yersinia pestis
uuguucaauggcgauuuguucaacgacaaccuguucaacgacuggcgucacuggauaa

SEQ ID NO: 4253530 - RNA, 62 nt, Yersinia pestis
ugggcugguauugaggucacgugcgauagucgguaaugccacguuggcaauagugccgucca

SEQ ID NO: 4253531 - RNA, 61 nt, Yersinia pestis
uuauuuaugaccuugcuaauuauuaaguccuguuacaugaggauaguaggguuauguguga

SEQ ID NO: 4253532 - RNA, 87 nt, Yersinia pestis
aaccugccaguuaccccgauguuggguggugguacauacaggaugacugaguguugccaaaggagcucagcaucaguaagacggguu

SEQ ID NO: 4253533 - RNA, 106 nt, Yersinia pestis
caucaauauuaugccccgugguucauuccgugccggugcugaagagcagcaauaauuuguacucuuucaccacggcacugagugaacagcacaauaaaacaagaug

SEQ ID NO: 4253534 - RNA, 72 nt, Yersinia pestis
gaauuauuagaugcgaugaugcagagcuaccguaauuugauccgcuuugcucgccguaauaaucugaguguc

SEQ ID NO: 4253535 - RNA, 81 nt, Yersinia pestis
aaguaccgccagucagggugguguuguucgcgguggcuuugucagccagcgagacgucacccgcgcugacuaccgucucuu

SEQ ID NO: 4253536 - RNA, 61 nt, Yersinia pestis
uuaccgguguucgcgguugaugcacuguagaguacaaaauuuucaccccggauaccguuga

SEQ ID NO: 4253537 - RNA, 86 nt, Yersinia pestis
uccauuaacuucuuucaguuuaucgggcagguguuaugcugcccgagcgugaugcuaaaacugugaacuagagagauuuuuaugga

SEQ ID NO: 4253538 - RNA, 124 nt, Yersinia pestis
ggggcaagcagggugccgagugcuguuaguggacaacgguaagaaagccgggcgcaagauauugauguccggcgguggccguugcaacuuuacgaacauuuauacggaaccugcggcuuaccuc

SEQ ID NO: 4253539 - RNA, 101 nt, Yersinia pestis
aucguucggcaccacaauaauggcaucgacauuuuucgcaauaagaucuucaaucacuuuaacuuguugcgcaggguccggugucgcuggcccgacuugau

SEQ ID NO: 4253540 - RNA, 85 nt, Yersinia pestis
auucagccaguggcgaucuauucauagaggacgauguauuuauagacgaugacguauucaugaguggcuuuccgcugugaugagu

SEQ ID NO: 4253541 - RNA, 77 nt, Yersinia pestis
accggcuuuacgcacgaugguccaggcuugcaucaaaugcugaugcuggcggcuaucgauguaauagaguauccggu

SEQ ID NO: 4253542 - RNA, 60 nt, Yersinia pestis
ggucgcaagaugcuaccgauggacaacaaacccacauuugccacguuggacucuuggauc

SEQ ID NO: 4253543 - RNA, 78 nt, Yersinia pestis
agcagacuuaucuuuauaacagacuugcuaccgcagcguuuuauccgccucggcagcaagcuguuaugcuuuacugcu

SEQ ID NO: 4253544 - RNA, 78 nt, Yersinia pestis
cauucgguauuaaucaguacuggugauaaagacauggcgcaauuaguuacgccgaauaucacuuugaucaauaccaug

SEQ ID NO: 4253545 - RNA, 76 nt, Yersinia pestis
gcauuuuggcaaaacuaucagguaaaaaaacggccuuaugggcuuuugguuuaaccgaugaaguguuugccgcugc

SEQ ID NO: 4253546 - RNA, 56 nt, Yersinia pestis
gagaccugauguugaucacguagcuccauaaucagcugauucaauucaucggucuc

SEQ ID NO: 4253547 - RNA, 86 nt, Yersinia pestis
cuucauuugguugcaagauggcguguauaacgaugagaccgauggucauaucgauaauaugugcuguuuuguccgcccaggcgaag

SEQ ID NO: 4253548 - RNA, 72 nt, Yersinia pestis
gcagcaaauugcauugaugggguuauuagaggcacugcgccgcuauggucacccugacgggcaauuugccgc

SEQ ID NO: 4253549 - RNA, 129 nt, Yersinia pestis
ucauugauugaugcaucaugaggcacguugauugcuuacuguaucuuaauuuuaugcuagcgucagguuagcgauaaaccgguaugcaggauaaaaagggauaauguuccucauuguauuaaguaguga

SEQ ID NO: 4253550 - RNA, 83 nt, Yersinia pestis
acgguuuaaacagaguauuaccgcaaaaugacucgcuacuugacacguaguaacaucgguuugcgguaauuuuuugagacugu

SEQ ID NO: 4253551 - RNA, 84 nt, Yersinia pestis
gguguaccgcucucugucacucgccgccugaugaaaagugcggauaacccggacgccguggccgacuggcagggggcggacgcc

SEQ ID NO: 4253552 - RNA, 58 nt, Yersinia pestis
gugaaccaauuguuagcuaaggguaaaaaauaauauccuuagauaacauaggguucgc

SEQ ID NO: 4253553 - RNA, 57 nt, Yersinia pestis
agugcggaaaauaccuuuuuaacugaggaagauguugcuaaaggugcaauccucacu

SEQ ID NO: 4253554 - RNA, 66 nt, Yersinia pestis
ccaguuuugccaguucagcacugcgggccagauguagccuuuccaaugcauuggcaaucaggcugg

SEQ ID NO: 4253555 - RNA, 55 nt, Yersinia pestis
ccgguaucugauauugcugcuuuagaagaccaagguaccaauaugaaguuacugg

SEQ ID NO: 4253556 - RNA, 71 nt, Yersinia pestis
cugagaaaauaaggguuacccagcgaauucagccacugcacggcuuugcuacggucaucuuuauaauucag

SEQ ID NO: 4253557 - RNA, 60 nt, Yersinia pestis
ggugucuugauuuuaacuaucggcguaauggcaccaauugccaguggcaaaaucagcgcc

SEQ ID NO: 4253558 - RNA, 56 nt, Yersinia pestis
uaaccucagauaggagacagggggauaaaaaccccugucuuauuuuuuguagguua

SEQ ID NO: 4253559 - RNA, 59 nt, Yersinia pestis
cugucugaugaauuacgugaugcggucgaggaugugauccucaaccgccgugaugacag

SEQ ID NO: 4253560 - RNA, 62 nt, Yersinia pestis
gcuggcgaguugagggagucuguucgcuacaccaucaagauaggcaacuucaauuaugcggc

SEQ ID NO: 4253561 - RNA, 102 nt, Yersinia pestis
acugacugcgcuggcacaagaaauagaacaagguuuagcgggcaacgguuuugccuuuuucaccguugaugcuuuuguucguuuagguaacgggcaggaagu

SEQ ID NO: 4253562 - RNA, 63 nt, Yersinia pestis
gcuucuggauuguuacgcggaucagcgguguacaaccccgccugaucggucaacaacaguagc

SEQ ID NO: 4253563 - RNA, 80 nt, Yersinia pestis
ugucaauggguuugguuauuaugauuggcugaugcgcgacauuuugugcucuggcuauauuaugaucaaacccauagaca

SEQ ID NO: 4253564 - RNA, 80 nt, Yersinia pestis
gguguuuuugcggauauugccaagcgggauugagucaucacuccaucauauucacgcuacguuauauccugcgauccacc

SEQ ID NO: 4253565 - RNA, 67 nt, Yersinia pestis
gcguuuugucgcauuacugaaugccacgccaaauggugugauccgcaugagugaugcgguuaaaggu

SEQ ID NO: 4253566 - RNA, 76 nt, Yersinia pestis
acucgcuuccaugccgccauauuuugccuuccaguuauaauagcuggcuucagagauggcgugcuuacggcagagu

SEQ ID NO: 4253567 - RNA, 91 nt, Yersinia pestis
uccagaccaucuucauuggaaaaauagaugucaccaaacuguucagauacagguguacccuguucauuccagcugaguguugcgguuugga

SEQ ID NO: 4253568 - RNA, 75 nt, Yersinia pestis
uuggcguggccgucagggucaggauaucaacaucagcccgcaucgcuuugauccgcucuuuaugacgcacgccga

SEQ ID NO: 4253569 - RNA, 61 nt, Yersinia pestis
acuucaucgcacuuaaucaacggguuaaaacaggccuuauucgcguugaugcagaugaagu

SEQ ID NO: 4253570 - RNA, 78 nt, Yersinia pestis
gauuuuugauagucagugcaucagaggaacaguaucacgaugauuauugugcuuucugaugccugauaaaaccuuauc

SEQ ID NO: 4253571 - RNA, 74 nt, Yersinia pestis
ugugacucgcccuuguuuuggcauucagcauuaucguugcccuugcccgagagccaacagcaacggcgcaagca

SEQ ID NO: 4253572 - RNA, 61 nt, Yersinia pestis
uagaucguuaccuuggcacccauuucuuuaccaaugauauggguggcaacaugaugaugua

SEQ ID NO: 4253573 - RNA, 61 nt, Yersinia pestis
aaugcggggguagucauacaaaaugagccuguccauaauucuguguaacugccaccguauu

SEQ ID NO: 4253574 - RNA, 129 nt, Yersinia pestis
uaugaccuugcuaaugguuuggauggcgggugaacaguacuuugcccguagcacugauuugggcuucucguuacuggcggguaguguucuucuccugcuaucacaugcugucugguugcugaaucgcua

SEQ ID NO: 4253575 - RNA, 77 nt, Yersinia pestis
aaacuuugaacaaacgcuuguuuaucauggugcucuaacaaggugagcgccucaccaaagcguuuguaguaacguuu

SEQ ID NO: 4253576 - RNA, 60 nt, Yersinia pestis
ucugguuaguggcagugauaucgcacugguugaugggcaaaugucacugccacaggcgga

SEQ ID NO: 4253577 - RNA, 78 nt, Yersinia pestis
cgcuacccucgccuugagugcuuacuggggauucaacguucugaauuacccugggacucaagguuaaacaugguggug

SEQ ID NO: 4253578 - RNA, 57 nt, Yersinia pestis
gguuccuuauagugaaguugcuuuuuaccuuugggcaauagacauaauuagggaacu

SEQ ID NO: 4253579 - RNA, 79 nt, Yersinia pestis
aucgcaauuuguacgacauuauucauuucgcuuugcggugggauuucccgcacauugaaauagaauaaugucucgcgau

SEQ ID NO: 4253580 - RNA, 109 nt, Yersinia pestis
caugacagccugaucgaagccaguacuuuuguucaaacgguugaaaaacgccaagguuuuaaaauugcuuguuuggaagagauugccuggcguaacgguugguuggaug

SEQ ID NO: 4253581 - RNA, 67 nt, Yersinia pestis
ggcgauauugcgucaggcacugggguuacagcaaagcccgccgaauaaaguccugaccgguaucgcc

SEQ ID NO: 4253582 - RNA, 112 nt, Yersinia pestis
agcgcauugauacaggcuaauauuuugcucuuuaauuauugggcucugaccauuuuugcguugugagucacaguauuaaaauggugagauuucagcagcuuaaaucggcgcu

SEQ ID NO: 4253583 - RNA, 56 nt, Yersinia pestis
uuuccugauacauaccaucuccugagaccaucaggcagaggcuauacacaggcaaa

SEQ ID NO: 4253584 - RNA, 60 nt, Yersinia pestis
aauggcgauggaaagacccacucggaaaauaugaucucuagucggccaaccaucgccauu

SEQ ID NO: 4253585 - RNA, 59 nt, Yersinia pestis
aagggugccuggcuaacgcuccaacugagucuuggggggauguuuuucgggcugcucuu

SEQ ID NO: 4253586 - RNA, 58 nt, Yersinia pestis
ucuacgucgaucaacugguacaacgcuguaccggcgaugccauugagaacggcgugga

SEQ ID NO: 4253587 - RNA, 81 nt, Yersinia pestis
gaucgcgagacauuauucuauuucaaugugcgggaaaucccaccgcaaagcgaaaugaauaaugucguacaaauugcgauu

SEQ ID NO: 4253588 - RNA, 83 nt, Yersinia pestis
gcaggcguccugaaggguauggcagcauagauaggcaauaauauuuuucuuugcuggcgucuucagugacuuuaaagguuugc

SEQ ID NO: 4253589 - RNA, 59 nt, Yersinia pestis
gugguuuugguauuggucauugauugcacagcaaucggugcgccaucaccaauaggcac

SEQ ID NO: 4253590 - RNA, 69 nt, Yersinia pestis
guggcaggaucugucuccucauggacucacgcagcuuaucuguucuaagccagaggcgacgccugccgc

SEQ ID NO: 4253591 - RNA, 59 nt, Yersinia pestis
aagaugacgauuuugguuucugcgagucuuguggcguagaaauugguauccgucgucuu

SEQ ID NO: 4253592 - RNA, 61 nt, Yersinia pestis
augcuguugccaagggaacuaacgugcguucuggcacacuggauccuuuagggagcgguau

SEQ ID NO: 4253593 - RNA, 76 nt, Yersinia pestis
uguucaauuuaagucgcagaugaugcaagggcacacggcuaccgucuugcagcuucgccucugcgaguucaaaacg

SEQ ID NO: 4253594 - RNA, 85 nt, Yersinia pestis
gggaaugcggcacaaaccuuacauccgauagccggucagggguuuaaucuuggccugcgggaugugaugucacuggcugaaaccc

SEQ ID NO: 4253595 - RNA, 79 nt, Yersinia pestis
ggcugggccaugaaacgcauauugcuggucggcugcuuuauauugcuggcugcggcgauaugguuucuggggccuuucc

SEQ ID NO: 4253596 - RNA, 127 nt, Yersinia pestis
aucaccaaaaauacuguugagcuacuugaaucuauuaugauagucgcaauauucgcuugucgcugacgauuugcaucuacuauuaaugaaucgauucaggcaaccguucucaguaccccagugugau

SEQ ID NO: 4253597 - RNA, 56 nt, Yersinia pestis
uugguagugaucaaccgguucaaucaggcugguggugaaggccgguaagcuaccaa

SEQ ID NO: 4253598 - RNA, 59 nt, Yersinia pestis
auucaguuccugauaugggguguaggaaaguccuugggcugaauaucguugaacaggau

SEQ ID NO: 4253599 - RNA, 65 nt, Yersinia pestis
gucagccaggaaaaccaaaccaucagcaauauugguaaucagaccaauaaugguugguuucugac

SEQ ID NO: 4253600 - RNA, 68 nt, Yersinia pestis
acgauggcaacauucagcggaacggauauauacccuaaauaauucgaguuauugaauguagccaacgu

SEQ ID NO: 4253601 - RNA, 56 nt, Yersinia pestis
gcggcguuucuucaugauugcaggccccuugauugcaacuauggggucagcgcugc

SEQ ID NO: 4253602 - RNA, 68 nt, Yersinia pestis
cagugaacuucauggcaaugcuauucagguuuucgccucccaucaucagcaucgcuaugaaauucuug

SEQ ID NO: 4253603 - RNA, 97 nt, Yersinia pestis
ugagguaaggcaacaaagcucgacaucaguaggauaugcaagcacaugaugccgaaauugaguuuaaguaaccgacuguuguggagcaccuuacuca

SEQ ID NO: 4253604 - RNA, 88 nt, Yersinia pestis
cuugucugggcgcaaggauguaugcuugaaggcuuaccggaccaauuuuaugaagccuuuauugaaugcauccagugccagacugaag

SEQ ID NO: 4253605 - RNA, 70 nt, Yersinia pestis
caguucgagagaaaaugccaguucaucggcaauccccgugaugggcugguuagcauuaucuuuaauauug

SEQ ID NO: 4253606 - RNA, 77 nt, Yersinia pestis
aggcagcccguuaugaacauccaguuuagcuugugggucaccauagggaccggaggugucauagaccgggauggccu

SEQ ID NO: 4253607 - RNA, 61 nt, Yersinia pestis
gauuuaccgguuuaaauggcuugccaugggcaugagugacuuccauuugaaucggaauguc

SEQ ID NO: 4253608 - RNA, 76 nt, Yersinia pestis
cuagaaacacgcgauggcgguaaucuauucuugggagucucaaugaaagcaaaaguucugucauuauucguucugg

SEQ ID NO: 4253609 - RNA, 89 nt, Yersinia pestis
auuuuuucaaugauguuuaagucucaauuuauuuugucgaucuauugagugucggacgugauuuauugugauuugacguguggauaaau

SEQ ID NO: 4253610 - RNA, 56 nt, Yersinia pestis
auccuucgcguugcaggggggguacucaguuacccccuuucugccacucgaaugau

SEQ ID NO: 4253611 - RNA, 70 nt, Yersinia pestis
ggauagggccgcgaccaguguggcguugccuuuuuucauugcgcuaucccagcauugguaggcccuaucc

SEQ ID NO: 4253612 - RNA, 67 nt, Yersinia pestis
gaugcgugaauuaucuaaugaaacucgugaaacuauucacuugggugcauuggaugaagauagcauu

SEQ ID NO: 4253613 - RNA, 64 nt, Yersinia pestis
guugagacuuuccgcgccaaagccgugguuuuggcgacaggcggcgcggcuaaaguuuaucaau

SEQ ID NO: 4253614 - RNA, 129 nt, Yersinia pestis
caaggagaggugaugaguaaaaucagaguauuguguguugaugauucugcauuaaugcgucagcuaaugacugagauuauuaacagucacccggauauggagaugguugcugcggcacaggauccguug

SEQ ID NO: 4253615 - RNA, 58 nt, Yersinia pestis
uugccaacuuugucucgggcuugauuauucucuuugagcggccuguacggauuggcga

SEQ ID NO: 4253616 - RNA, 76 nt, Yersinia pestis
cuugguuuuugguguagacauuuuugcgcuuagugagugauuucuuugacgcguguugcuauuccaaucaauuaag

SEQ ID NO: 4253617 - RNA, 60 nt, Yersinia pestis
ucaauuugugcgugcgccgcuggauaacgauaucgguaucagcgaagcuacgcauauuga

SEQ ID NO: 4253618 - RNA, 75 nt, Yersinia pestis
gggccaaccaucugaucacgggugaccauaccgguuaccgugcggucgccgauggugaucaggaagguuuuuucc

SEQ ID NO: 4253619 - RNA, 118 nt, Yersinia pestis
uaauuaccuuuucugcucuguccaaagucguuggcgcugaggcagugaagcaaaugagcgaauuuuguaaaguggcucaugucaguaacucgggugagacggugagaaaaggugguua

SEQ ID NO: 4253620 - RNA, 76 nt, Yersinia pestis
gauuauugugugcucuugccgcagguuuacucccuaccucaaaacgcaguaaagggaccucggugccacaaaaauc

SEQ ID NO: 4253621 - RNA, 61 nt, Yersinia pestis
cucgacgaguuauguagacuggcugccauuauuaaugaggcacguguacaugacuacugag

SEQ ID NO: 4253622 - RNA, 71 nt, Yersinia pestis
gcaagccacuguucucuucucacaugaucgaccugucugaagagucucuggaagagaacauugaaauuugc

SEQ ID NO: 4253623 - RNA, 55 nt, Yersinia pestis
gcaccugguaguuggcaccacuccgggccaguuccaagugccgaucaccgggugc

SEQ ID NO: 4253624 - RNA, 123 nt, Yersinia pestis
guaaaguacgccaugggcuucagucauuauuacgggaaacacaggcugacgaauugaugauuaauggccaaauuuuugaucaucaagcacggcuguauuccuuugaaaccguugccagcuuac

SEQ ID NO: 4253625 - RNA, 66 nt, Yersinia pestis
uugcucgauagagauagccggagacaggccuucaauauggucaacauccgguuuuuccaucagcga

SEQ ID NO: 4253626 - RNA, 81 nt, Yersinia pestis
cccugaacgugucagugagaugguucugcgugggaucuucacuuuacgcaggaaagaacugcauugguacuaucaagaggg

SEQ ID NO: 4253627 - RNA, 102 nt, Yersinia pestis
gcugagcgugguacccgugcggaacaggugaugcagguggaaaaagagcuguucgcgcuguacgccgauccgcauuuggauaccaaaccagagcagcucagc

SEQ ID NO: 4253628 - RNA, 90 nt, Yersinia pestis
gucaaauuuaccgccauucaguguggugucauucgcuguggcauuuucagccagagugaaauuaccugcacugaguugggugucuuugau

SEQ ID NO: 4253629 - RNA, 59 nt, Yersinia pestis
ggguuugucagcauucugaaggccgcugaugcggccuucaggguauugacaaagugccc

SEQ ID NO: 4253630 - RNA, 84 nt, Yersinia pestis
guuauagauaauuaugauggauggcaaguuaacgugcuguuuuauaacaaguaacguuagucauuaaucaggauuuauugugau

SEQ ID NO: 4253631 - RNA, 76 nt, Yersinia pestis
gaaugguuugguauguggaugucaaagcaauggaauggcguuccuaaugcuuuccgcuucuuugucaccaccauuc

SEQ ID NO: 4253632 - RNA, 105 nt, Yersinia pestis
gccgucacgaaaacguaucgauuuaugguuccgucgccagcguauaacuaacccauugauuuaugccacgguguccggccaugaagcgauuguuuccaugguggc

SEQ ID NO: 4253633 - RNA, 58 nt, Yersinia pestis
aguaacgaauuacgcugaauuguuccccauuuagugacuguucagugcguucgauacu

SEQ ID NO: 4253634 - RNA, 71 nt, Yersinia pestis
gugcuggccgcccugaacacccugccgacgcugcaacagcgugucgguaaccguuacggggcaccgggcgc

SEQ ID NO: 4253635 - RNA, 103 nt, Yersinia pestis
gcacauuuagguucacuggaguucgcuaaacgcuugcuggcagaggcgaaggugugugucucgccggggauuggcuuuggugacuacggugacacgcaugugc

SEQ ID NO: 4253636 - RNA, 66 nt, Yersinia pestis
aggucuuaaaaguacccgcuagccgcacccaccaauucgaaguggcgucagugcgcaguaagaccu

SEQ ID NO: 4253637 - RNA, 70 nt, Yersinia pestis
gcugguggcguucaccuucguuaacuugucugugauugcucaguucuauguucgugaacgccgcaacagu

SEQ ID NO: 4253638 - RNA, 70 nt, Yersinia pestis
cguugcgggcacuuugucaauacccugaaggccgcaucagcggccuucagaaugcugacaaaccccgaug

SEQ ID NO: 4253639 - RNA, 57 nt, Yersinia pestis
ggaaggaacugucaaaccacuugcugaugagcaauuaugguuuaaccaguuccgucu

SEQ ID NO: 4253640 - RNA, 61 nt, Yersinia pestis
uugaucauggcugaggugugucuuguggcaagaauaaacagccacacuucgggcagaucaa

SEQ ID NO: 4253641 - RNA, 124 nt, Yersinia pestis
guauuugacguugcagggguguuagcggcucuuacucacucgaaucacuggcuugucguugaccuuacagcgaauaaguucaucgggauucguucguuugcugccuaucugcaacgccaacuac

SEQ ID NO: 4253642 - RNA, 113 nt, Yersinia pestis
gugucucccgugauaacauucuucgguauucggaguuugcaucgguuugguaagccgggauggcccccuagccgaaacagugcucuacccccgaagaugaguucacgaggcgc

SEQ ID NO: 4253643 - RNA, 72 nt, Yersinia pestis
gcauucgaucuuucauuuaugcgcuguauuccaaacauggucauuauggcaccaagugaugagaaugagugc

SEQ ID NO: 4253644 - RNA, 63 nt, Yersinia pestis
ggcaguggcgauaccggcaguaggcuaaagccaauuaugccacugagggugaucgccagcguc

SEQ ID NO: 4253645 - RNA, 93 nt, Yersinia pestis
gccaucacagacguggguuucuacgauuaacaugaucguguugcugggugcagaacccguaauggucgauguugaucgcgauacauugauggu

SEQ ID NO: 4253646 - RNA, 56 nt, Yersinia pestis
ggucggauguuuugaccgguguaacggguaaagaucccgguuaugacccucuggcc

SEQ ID NO: 4253647 - RNA, 69 nt, Yersinia pestis
gaaguuaugggcgcgcauauuggcgguacuccgugccauaccaccgccagaaugcacucuauuaauuuu

SEQ ID NO: 4253648 - RNA, 83 nt, Yersinia pestis
ccacgcgacguucagacagugugccguuguuguggauguaugcugccauuccacugcaauaugucuggaucgggaugucgugg

SEQ ID NO: 4253649 - RNA, 57 nt, Yersinia pestis
ggugguugggucgcuauguugcagcaguauuucgccacagcauggaucccagcggcu

SEQ ID NO: 4253650 - RNA, 71 nt, Yersinia pestis
gguacugacgguacgguggacaguuauuucaagaaaaacuuggagaguaaagucgacacguccucaauacc

SEQ ID NO: 4253651 - RNA, 60 nt, Yersinia pestis
gcugcuuaaacccgguaugauuuuuacuaucgaaccgaugauuaaugccggaaaagcggc

SEQ ID NO: 4253652 - RNA, 116 nt, Yersinia pestis
gguuugcgucgguggaauaaagcugaacugguuaaacaauacggugcccugaucgccagauucuugcuccagugccugcaucuguuuaccgguaugcugaaugcugacgaucugcc

SEQ ID NO: 4253653 - RNA, 83 nt, Yersinia pestis
aaggggucacgcgcugcacugaaccccagaucuuggaucuuuuuauccaugaucuggagguucgguucaaugaaacacccuuu

SEQ ID NO: 4253654 - RNA, 96 nt, Yersinia pestis
gguguguuggauauuccggguuucuauguuggccugaccgaagacguuaaggugcaauuacagaagcuugagaaacagaaugucagcagcaucauc

SEQ ID NO: 4253655 - RNA, 63 nt, Yersinia pestis
ucgcuauacgcaaauccgggcuugggaucaggaaaucaucccucuggcugagcguaucagcga

SEQ ID NO: 4253656 - RNA, 71 nt, Yersinia pestis
ccuucauuauuuugugccacuacauggcaauugaggucugcuugaguuacuuaugggggcacaaaagaagg

SEQ ID NO: 4253657 - RNA, 80 nt, Yersinia pestis
cgccacgcuggcgcagaaauugauugaugauggcuaucaggucaucuuauucgguucugcgaaagacaaugaagcuggug

SEQ ID NO: 4253658 - RNA, 55 nt, Yersinia pestis
guugaugagugccugccgguagccacuaauacggucguuggcggcauccauccac

SEQ ID NO: 4253659 - RNA, 69 nt, Yersinia pestis
ggugauaucaauaucgcugagccaaaagcguuaaucggcuuugcuggcccacguguuauugagcaaacc

SEQ ID NO: 4253660 - RNA, 69 nt, Yersinia pestis
agccgucgcggcgauggccaguuuuuaccgcauucugccggaagagauucuagucgcccacgaugagcu

SEQ ID NO: 4253661 - RNA, 73 nt, Yersinia pestis
cuccgcuugguuaacugcgucauuaaggacugggcgcaagcgcccugaaaugacaguguuacccgagagagag

SEQ ID NO: 4253662 - RNA, 57 nt, Yersinia pestis
gacacauauuucaggcuguugcguaccauauggaugaugcacagcuggaugugaguc

SEQ ID NO: 4253663 - RNA, 70 nt, Yersinia pestis
uguuuuuagauguuuugcuuuugucauccgugguaaccacauccauggaaauaacaagcgagacaaaaca

SEQ ID NO: 4253664 - RNA, 57 nt, Yersinia pestis
auacugaagucaguuuuucgccguugaaaucgguagaaacaacgucaucuucgguau

SEQ ID NO: 4253665 - RNA, 57 nt, Yersinia pestis
ccaccgaugugcuucaccaguuaggccgaaacccacaggugacgguagcgacggugg

SEQ ID NO: 4253666 - RNA, 55 nt, Yersinia pestis
cuggccagacuguacgcuuuggccugaaugaaccaacccaaggucaucuugccag

SEQ ID NO: 4253667 - RNA, 68 nt, Yersinia pestis
cgacgauaaacugguaagcgccagugcaaccgcacaagcgguaaaaggcaaauaucauuuauucgucg

SEQ ID NO: 4253668 - RNA, 88 nt, Yersinia pestis
ccccguaugcugagccaauaaccguuuggugcugcucaccuuuuuaucagaagggagcaagcccaaagcgauauauguccggcugggg

SEQ ID NO: 4253669 - RNA, 127 nt, Yersinia pestis
gacucauugauauuaacuggucuagcgcaguacucaccgccguauucaaaauagaaaagcgccaucaggcgcuuuucuauuggauaaggugaugaaugacuggcuauuagaauguguaguugaaguu

SEQ ID NO: 4253670 - RNA, 118 nt, Yersinia pestis
uuuguacgauccagaacgccuaaauagucguggguucacuuauuauggaauugggcgugguguuucgauuaaucuaucauaguaagugagaaugcugauuuuauguguugauuacaaa

SEQ ID NO: 4253671 - RNA, 87 nt, Yersinia pestis
cgcugugacgcgaauauuauugucgaaaccgccagcgcacgugauccacaccacuucgcggugcugcucgguuuuggugcgacagcg

SEQ ID NO: 4253672 - RNA, 79 nt, Yersinia pestis
augcgguaaccgacggugagucagcccgugagugcauugaagaaaaccgcauucucaaacggauugcucgccacugcau

SEQ ID NO: 4253673 - RNA, 102 nt, Yersinia pestis
uugggagaaaagaaugauuucauggaaguuauggggaauguuuuagaaaaugccugcaaauauugccuugaguuuguugaagucaccaccuuacacuccgaa

SEQ ID NO: 4253674 - RNA, 68 nt, Yersinia pestis
ggugguguggugaaaagcgggaccuuccagcaguuuauccguggugguaucgcuuucgcuacgccacc

SEQ ID NO: 4253675 - RNA, 65 nt, Yersinia pestis
gcggguauuccaugugguugcggcuauccccuaugggcagguagcgaccuauggcgauauagcgc

SEQ ID NO: 4253676 - RNA, 65 nt, Yersinia pestis
ccgugggcuugaaguuggcacugucaccgguuuuaaucugggugcaauguccgaucgagugcagg

SEQ ID NO: 4253677 - RNA, 79 nt, Yersinia pestis
uguaccuguuugaaagccugaaucugcugauucaacguuaccugccagaggagcagauuaagcgccucaaacaggcaua

SEQ ID NO: 4253678 - RNA, 79 nt, Yersinia pestis
ugguuaaaaugaguauaggcuggccugggcgcuuucucaauaauaaauuguucccggccaguguguaucuuagugacua

SEQ ID NO: 4253679 - RNA, 71 nt, Yersinia pestis
ucaugcgcuaaguugucuguuugcuguauaaaguugucaaaaauuuguaaaacggccaauuagcgucauga

SEQ ID NO: 4253680 - RNA, 67 nt, Yersinia pestis
aggaucgguguaauguguugacgcagaugcuguuuaaaguauugcuucagccacguuugcugauucu

SEQ ID NO: 4253681 - RNA, 79 nt, Yersinia pestis
gacucgcaaugaacagaucgcugaauuacuuuccggugcuguagcgccagagacaaugucgacgacguuuauugcaguc

SEQ ID NO: 4253682 - RNA, 76 nt, Yersinia pestis
gccaauacauaggagaggguagagaagugaccgauggcuacaucaucagauccugucaccuucuucauguaagggu

SEQ ID NO: 4253683 - RNA, 58 nt, Yersinia pestis
ccuuucagcagcgcaggaagguuugccaugacaacuucucucauuugcugcugagagg

SEQ ID NO: 4253684 - RNA, 60 nt, Yersinia pestis
uugcaccacaauaucgccgcuguuugccgcauuccccucaccgguggcauugauggucag

SEQ ID NO: 4253685 - RNA, 87 nt, Yersinia pestis
gaugucaugaaguugcagaucaaagugaaugaagccgguauuauugaagacgcccgcuuuaagacuuaugguugcgguucugccauc

SEQ ID NO: 4253686 - RNA, 73 nt, Yersinia pestis
gggcauuuacaccauuccugaaaucaguucugucgggaaaaccgaacaagagcugacggcgaugaaagugccc

SEQ ID NO: 4253687 - RNA, 129 nt, Yersinia pestis
ucugagucagucaaguagucuggcauuugccauuggagucuucgcuggcagugccuauugcaucguauugguaaugagccuauugcugcccgagaccaaaaauaaacagcuagaauaagugacgauuua

SEQ ID NO: 4253688 - RNA, 61 nt, Yersinia pestis
uaaugguauuaucgccgacucuauggauuaguguuuuuuugauauggcgguuuugccauua

SEQ ID NO: 4253689 - RNA, 77 nt, Yersinia pestis
acauucgcauggguacugaaagaaccugaaucuugccauccuccgaggucuggacgaggcaguacccagccgaaugu

SEQ ID NO: 4253690 - RNA, 82 nt, Yersinia pestis
cgguuggccaaugaagccaggguugcagcaacgccgaaaacgguggaacaauugcugaaauuaggcuucaccguggcaauug

SEQ ID NO: 4253691 - RNA, 58 nt, Yersinia pestis
guauugaagucgcauucgcgggccgcucaaacgcggguaaauccagugcacucaauac

SEQ ID NO: 4253692 - RNA, 63 nt, Yersinia pestis
uaaugcuguuaugagcaugcauuacccauauuuauguuuagugcuacgcuuaauaauucguug

SEQ ID NO: 4253693 - RNA, 55 nt, Yersinia pestis
ucacgguuucccguacuuuuaaucaaccuggauuaguuaaacaagaaacccguga

SEQ ID NO: 4253694 - RNA, 59 nt, Yersinia pestis
uauccauauagcuguucaggguacgggucaucgccguacggaaaccaacuaaaugggua

SEQ ID NO: 4253695 - RNA, 71 nt, Yersinia pestis
acgaaguuguagaacuuaauuguuauggagauaagauucuuuccccgaauacaguuauguuuuauuuucgu

SEQ ID NO: 4253696 - RNA, 66 nt, Yersinia pestis
cugaauauugcugcgaguuucgauaucacugcccacacugacgauauugcguagcauaucuuucag

SEQ ID NO: 4253697 - RNA, 90 nt, Yersinia pestis
gucacugaguggcucuauuuuguugauuucaugcgaggugcgaaaaccaucaaagaaauggauaaagggaauucggcuauucaggguggc

SEQ ID NO: 4253698 - RNA, 60 nt, Yersinia pestis
ccauuugcggccuaaauaccgcuugccgauaguuggcaagacgguauuuaggcgcugagg

SEQ ID NO: 4253699 - RNA, 64 nt, Yersinia pestis
ggcuaugcaaagugaacguggucgccugcaacaaaaauuaggugaacaguucucugugcuggcc

SEQ ID NO: 4253700 - RNA, 84 nt, Yersinia pestis
ugcuggcugccgcgcuggcugcagguaacagccuggaagagucauguuuccuggcuaaugcugccgccgguguaguggugggua

SEQ ID NO: 4253701 - RNA, 59 nt, Yersinia pestis
gugcggcggcgggguguuccugaugcugucggcggcauccggcuggccugucgccaugc

SEQ ID NO: 4253702 - RNA, 96 nt, Yersinia pestis
gauaaacuccguaaucuguucgggcugauuaauauccaauuguuuuaccgucgucucuauuggcuuaucacuugccagagcaauaacguguuuauc

SEQ ID NO: 4253703 - RNA, 92 nt, Yersinia pestis
uugccggcaaaccguagaaucagguggaaaucaugccuuuaucggcuuugaucacuauuuuucaccgauugugacuuuuuuagggcuggcga

SEQ ID NO: 4253704 - RNA, 100 nt, Yersinia pestis
ugagucggagcucagccaccgagcggcacaagauaccuuaccgcuacgugaugcguuugcggugcuguucuucgucucugucgguaugcuguucgaccca

SEQ ID NO: 4253705 - RNA, 75 nt, Yersinia pestis
gggucgcaggucagaccuaaguuguguuccaugccaaucucggcugcgauacagacuuggaucgggcuagcaccc

SEQ ID NO: 4253706 - RNA, 72 nt, Yersinia pestis
uaccucaaucacugggcugcaccccaaaaguuggauacccaacugaauaaggugcaguuuuuuauugaugua

SEQ ID NO: 4253707 - RNA, 63 nt, Yersinia pestis
uacgccaccaauuuugacaggagagugguuuuuuaagccgccaauauugucaaaauucgcgua

SEQ ID NO: 4253708 - RNA, 71 nt, Yersinia pestis
cgcaguugagcuucaugcacuguugccacgccauauucagcgaaacguuguaacagggcuaguucagcucg

SEQ ID NO: 4253709 - RNA, 55 nt, Yersinia pestis
agcgccgggccguugguaucuuaagccgucuggcgaugaugacgggcuuggcgcu

SEQ ID NO: 4253710 - RNA, 63 nt, Yersinia pestis
auauucugaacuggaagaagaguggaaagcagaaaaagcuucacucaccgggacucagaauau

SEQ ID NO: 4253711 - RNA, 94 nt, Yersinia pestis
aucuuccaaugcagagguucgcgcggcuaaugagagacuuuaacuuaaugaaaguuaaggauugucauuagucgcgaggaugcagugugaaggu

SEQ ID NO: 4253712 - RNA, 83 nt, Yersinia pestis
cauucuucgguauucggaguuugcaucgguuugguaagccgggauggcccccuagccgaaacagugcucuacccccgaagaug

SEQ ID NO: 4253713 - RNA, 80 nt, Yersinia pestis
cucuggcagacuuuuuuagcguacagguguacacugaaaucacucucaguuaaucugagugcgcuauuucuguacaguag

SEQ ID NO: 4253714 - RNA, 104 nt, Yersinia pestis
cccgugauaacauucuucgguauucggaguuugcaucgguuugguaagccgggauggcccccuagccgaaacagugcucuacccccgaagaugaguucacgagg

SEQ ID NO: 4253715 - RNA, 79 nt, Yersinia pestis
gaauucguugccgcuacuugauguacagcauuugacugaugagcaaacugcacuggcggucgagaggcucaauuuauuu

SEQ ID NO: 4253716 - RNA, 66 nt, Yersinia pestis
uuaauuuuauuacuaacaggcuaauaaacaucgcuuuauuuauuaggaugguuagagugggauuaa

SEQ ID NO: 4253717 - RNA, 63 nt, Yersinia pestis
gauaaugccuugauugaaggagauuuccguaaacgugcuuucuaucagcucggcggcaguauc

SEQ ID NO: 4253718 - RNA, 74 nt, Yersinia pestis
cuggcggcacagaugcuggagaaggucgggcuggcagaucgggucgauuauuacccggcgaaucugucuggcgg

SEQ ID NO: 4253719 - RNA, 60 nt, Yersinia pestis
gcuggcugagaucggcaaucuguaugcgagaaaucgggccuugcugaucaauuagccggu

SEQ ID NO: 4253720 - RNA, 70 nt, Yersinia pestis
gacacauauucauuuucuugagccagucagccagaccaaaaugguuuggcaugugggcuaucaggauguc

SEQ ID NO: 4253721 - RNA, 82 nt, Yersinia pestis
gcugaaauuggcguaauacaccauugauaaguccuuuuaauuguggacguuucaguacuguugcgccuucgaccguuucagc

SEQ ID NO: 4253722 - RNA, 88 nt, Yersinia pestis
gagaaaggggccaaguugcacugaaccccagaucuuggaucuuuuuauccaugaucuggagguucgguucaaugaaacacccuuuuuc

SEQ ID NO: 4253723 - RNA, 78 nt, Yersinia pestis
cguuagguacauuauugacucauauaaccucaaucauacaggucauuugaggauuauucauggugaaugguacugacg

SEQ ID NO: 4253724 - RNA, 64 nt, Yersinia pestis
uaggcaucucugucauccaguaacacaucacuuugugcucuuguggacugaacagggaagccug

SEQ ID NO: 4253725 - RNA, 60 nt, Yersinia pestis
uaaugcucagcaaccaguuucuccaaaggcucaccagccagugcuggugcgugagcauug

SEQ ID NO: 4253726 - RNA, 62 nt, Yersinia pestis
guuacaucagagcucaauuuaacgggcacccgauaugcccguuaaguuuagucuagucuagc

SEQ ID NO: 4253727 - RNA, 60 nt, Yersinia pestis
aacauggcguuuaaucugaagcuggcuaaaaccgaaccggcugagauagagcgccguguu

SEQ ID NO: 4253728 - RNA, 65 nt, Yersinia pestis
gugaaucuaauuacccaagaugucgccucagacgaugaagugacccuuuucgguauuggauuuac

SEQ ID NO: 4253729 - RNA, 66 nt, Yersinia pestis
aaaaaaacaccgcacaagguaaacggcccuauuuuggggccuguucacgauaggcgguguuuuuuu

SEQ ID NO: 4253730 - RNA, 59 nt, Yersinia pestis
aucugguacuggauguagauuauaaugauucagucguugucauuaauaccaguccaggu

SEQ ID NO: 4253731 - RNA, 76 nt, Yersinia pestis
ucuuucacgauuuaaguuuccauuuuuuaugucguuuguuaugagugacuauugaauggaaacauuaagugaaaga

SEQ ID NO: 4253732 - RNA, 57 nt, Yersinia pestis
ucgagagcauuaauccauugcuacgcgcguuacgcagaucagugaucaaugccucga

SEQ ID NO: 4253733 - RNA, 115 nt, Yersinia pestis
uuaccacugccugauggccccaaaauaccuagcacaucaccggguugcaguucaaaguugauggaguguaauacuggaaugugcgugcccggcuugcaggccauaaguugcguaa

SEQ ID NO: 4253734 - RNA, 55 nt, Yersinia pestis
augggagacgcuugugaugcaagaaaacaauaucuucaucauuugcaacucccau

SEQ ID NO: 4253735 - RNA, 120 nt, Yersinia pestis
gcgugauguggcgguaugggagcaugaucuacaccacgccauggauaauauccaagacgagauugauaugguggguguggaaggugccaguauggaugccuaugcagccagcaauccagc

SEQ ID NO: 4253736 - RNA, 62 nt, Yersinia pestis
gccauuuucuuuccagcaguuuucaggccaaaaccagccugcuacugccacaggaagagggc

SEQ ID NO: 4253737 - RNA, 74 nt, Yersinia pestis
ggugacgaauuacucagugaacucgaugauaaucaaacguuuugguugcaccgggcgcugaaagguucauugcu

SEQ ID NO: 4253738 - RNA, 64 nt, Yersinia pestis
agcagccguaguccaacccaguaggcccagacaugccgguacgccacuggguggacaucgcucu

SEQ ID NO: 4253739 - RNA, 95 nt, Yersinia pestis
ggcagcucacgggcggccuggcucaugauuuuaauaaccugcuggcggugauuauuggcagucuugagcuaaccgcuacggacucgucggaugcc

SEQ ID NO: 4253740 - RNA, 62 nt, Yersinia pestis
guuguugcauugccugaaguaauugcccgugagucgcacaaugccaggcaguguauucauac

SEQ ID NO: 4253741 - RNA, 66 nt, Yersinia pestis
gcguuauuuccacaauuuguacugccacagcaaccgcagguggcacaguauuugauuuugggcagc

SEQ ID NO: 4253742 - RNA, 66 nt, Yersinia pestis
uguugcuuuaucuguucacgcgaaacgggcacuuucguuaucugugguugacagacaaagagugca

SEQ ID NO: 4253743 - RNA, 72 nt, Yersinia pestis
augggcauuagccaaacagaacugaucuuuucccuuuuacaacagauguguguguauuugguuauugccuau

SEQ ID NO: 4253744 - RNA, 64 nt, Yersinia pestis
ugauggugcucuuuagcguuuugcucuauauccauggugagcaagucgccuuagguauccguca

SEQ ID NO: 4253745 - RNA, 56 nt, Yersinia pestis
uggcgaugguuggccgacuagagaucauauuuuccgagugggucuuuccaucgcca

SEQ ID NO: 4253746 - RNA, 58 nt, Yersinia pestis
accuuacauuuuuaaauugggggugaguaauugcuuuuacuaucuaaaaguuuaaggu

SEQ ID NO: 4253747 - RNA, 56 nt, Yersinia pestis
aucgcgcggguaucgagcuggucgccagcaacagugccagcuugcaauucggcgau

SEQ ID NO: 4253748 - RNA, 57 nt, Yersinia pestis
gcaugacugauaccgguccauggaccauaaaguccaaacucggccuuucagucaugc

SEQ ID NO: 4253749 - RNA, 55 nt, Yersinia pestis
ggugacugaggaugauugugguacccauaacgguaucgugaugaccccgguuauc

SEQ ID NO: 4253750 - RNA, 76 nt, Yersinia pestis
cggacagcaggacuaugagcacgcuugaacuucaucauaucgguaagucuuaucaaucugucaugguacuggaccg

SEQ ID NO: 4253751 - RNA, 63 nt, Yersinia pestis
guuaaacguggggauucucugaccauuaacaugauggccuucgcggucccuacguugauugac

SEQ ID NO: 4253752 - RNA, 63 nt, Yersinia pestis
ccgccgugaaugauauguuggccgguaacgcuuuuggugaugcagggcaccguaucguggugg

SEQ ID NO: 4253753 - RNA, 62 nt, Yersinia pestis
gucggcgauaaccgucaggggcacgcucuuaucugggccaugucacugauuuuuaucguugc

SEQ ID NO: 4253754 - RNA, 58 nt, Yersinia pestis
ucuaugauuugaaaggugauuuggaagcaauucuggagcuuaccggcaaauuaucuga

SEQ ID NO: 4253755 - RNA, 73 nt, Yersinia pestis
ggguauuuuggucgguauuaucucugcugagcuuuauaaccguuucagcggcguugaacugccaaaagcgcuc

SEQ ID NO: 4253756 - RNA, 79 nt, Yersinia pestis
accugaugcgugguucaaugauggucgaagggcguguagcacgcgucguuuauaucucguuguaucguaugcaucaggu

SEQ ID NO: 4253757 - RNA, 62 nt, Yersinia pestis
ccagacgucugacaugguacguguugauguauuaaucaauaacgaacguguggaugcgcugg

SEQ ID NO: 4253758 - RNA, 60 nt, Yersinia pestis
gaugaguuuugcguuuaaugaacagggcaguucaccgcuggcuguaggcaaaaacucauu

SEQ ID NO: 4253759 - RNA, 74 nt, Yersinia pestis
guuccauggccuggguguggaugccuuugaccgacaaauacaggggcguagcccacaggcugaaguuguggaac

SEQ ID NO: 4253760 - RNA, 90 nt, Yersinia pestis
guuaccgaauucagcggccacuucacggaugauauggauacucuccgccuccaauugccguaaaugagugagucguuuuucguccauaac

SEQ ID NO: 4253761 - RNA, 120 nt, Yersinia pestis
gcguuagagcauaauaauaacgaucaggccaaggcgcaggaguucgugaaugcucuguauaagaauguagaaguauuggacuccggcgcucgcggugcgacuaauacuuuuguugaacgu

SEQ ID NO: 4253762 - RNA, 67 nt, Yersinia pestis
ccgcgcugauacgccaaauauuuuucggauucugguuguugaaaggagauauuuugcguguagccgg

SEQ ID NO: 4253763 - RNA, 72 nt, Yersinia pestis
agggagaggcucuguuagcgguaaagugcaguaagaagacgcggguauuuugcgcugauggaccucugcccu

SEQ ID NO: 4253764 - RNA, 75 nt, Yersinia pestis
uugccauugcaggcgguuagccgugagaucagccagcaguugcggcguuuucagguuaccgcguaauuucagcga

SEQ ID NO: 4253765 - RNA, 67 nt, Yersinia pestis
cagugcgucccagcuacugcuacucagcgauuuacuggugacgcugacaguaccuugcggacggcug

SEQ ID NO: 4253766 - RNA, 69 nt, Yersinia pestis
gcuggcaagaauucuuucaacagcuucagugcuugcagcgccuggccgucagaguauucauuagccagu

SEQ ID NO: 4253767 - RNA, 123 nt, Yersinia pestis
gugggacgguggcugacgauggcacaauucggauuauguuauagucguuaaaguuuuuuuaaccuuugccgauaauuaacauaagccguuauuugcagguuaaugaauaagugaccaucccgc

SEQ ID NO: 4253768 - RNA, 57 nt, Yersinia pestis
uaacggguaauuaugccgcaugaguuggcccagauuucacggcguaacuggccguua

SEQ ID NO: 4253769 - RNA, 66 nt, Yersinia pestis
uuggauauuggcccguggguguagaucgucgccaucaauaaauuuagcgccaagggccaaugccag

SEQ ID NO: 4253770 - RNA, 85 nt, Yersinia pestis
acgccugcccggugcuggaagguuaauugauggggucagccgcaaggcgaagcucuugaucgaagccccaguaaacggcggccgu

SEQ ID NO: 4253771 - RNA, 77 nt, Yersinia pestis
auuauuuuaguguugucgcugacgauaagcagcauccccgcguuugcagcuaugacgaucaguggcacacgugugau

SEQ ID NO: 4253772 - RNA, 68 nt, Yersinia pestis
ggagcugcuuggcuuuggccacauccacugccaguucacgccguucugccagcaaagccagcaguuuu

SEQ ID NO: 4253773 - RNA, 92 nt, Yersinia pestis
gccagucaacgauguuuuugccauggcucaggucgaaggcagcgauaaaccgcugaguaaccugaaggcugggcaagaggucaagaucaugc

SEQ ID NO: 4253774 - RNA, 81 nt, Yersinia pestis
gggcuacgauuaguggcgaugcuggcaaugcugguggucaucauggccgguauuaaagcggcaucaccaauugucgucccc

SEQ ID NO: 4253775 - RNA, 70 nt, Yersinia pestis
accugaccaaagaacaggccgaagguuuuuacgcugagcauaaaggccgcccguucuuugaugguuuggu

SEQ ID NO: 4253776 - RNA, 72 nt, Yersinia pestis
gcaggaagagaaugccugugcgguuauucaauuugaugauguuuuugaaacggcagagcaauuuacugaugc

SEQ ID NO: 4253777 - RNA, 56 nt, Yersinia pestis
gacgcuuuugauccggcgcuggaagaauauagccaccaguuaauggaaaaagcguu

SEQ ID NO: 4253778 - RNA, 79 nt, Yersinia pestis
cagcgagaucccaaaggcucacaccaccgaguucaaccguuucuucuggauaagugcuguagucuuugucauaacgcug

SEQ ID NO: 4253779 - RNA, 87 nt, Yersinia pestis
cagagcaacuguaucuugcaagguugguguacgauuaucugcccgaacaucaggcucuauaccaaccugcaaggaugccaacgccug

SEQ ID NO: 4253780 - RNA, 91 nt, Yersinia pestis
cugauaagccagcgcugauugccagcauucaacagcacauucacccaaggggaaugaccgccuuguuugcuggugucaguauggguauugg

SEQ ID NO: 4253781 - RNA, 88 nt, Yersinia pestis
uggccuucagcagacaaugucaucgcgauccagaccugacucuggcaaccggagaucagauucucuggguggcgcuguuguucgguca

SEQ ID NO: 4253782 - RNA, 101 nt, Yersinia pestis
gagguggcuucacguggcauuacugucaacguuguggcaccuggcuuuauugagacggacaugacuaggacguugacggaugaucaacgcgcaggcauuuu

SEQ ID NO: 4253783 - RNA, 61 nt, Yersinia pestis
guuagguauugagagaguuuaaaucaaugaagaaaacaucauuacuucuuagugcgcuagc

SEQ ID NO: 4253784 - RNA, 110 nt, Yersinia pestis
auccaauccguguucugcgugacaacgugguuaucuaugaaggcgagcuggaaucccuacgccgcuucaaagaugacguuagcgaaguucgcaacggcauggaguguggu

SEQ ID NO: 4253785 - RNA, 84 nt, Yersinia pestis
ucauuccguagcagcuaaauacgaucuaaugaaugaccugaugucauuugguguucaucguauuuggaagcguuuuacgguuga

SEQ ID NO: 4253786 - RNA, 74 nt, Yersinia pestis
aggcgucuauuaugaaaugauucuuugugauugugacuaaaauuauuacgacagucucauuuuagcagcagcuu

SEQ ID NO: 4253787 - RNA, 104 nt, Yersinia pestis
ggaugggcgcaccauuuugguaggcgaugaucaggucacgguacucuucggcggacuucaucugaucauuggcugauagcgucaccgaacggguuggcccaucc

SEQ ID NO: 4253788 - RNA, 72 nt, Yersinia pestis
cgccguauggcagugccuggauauaucuguaucgcuugccgacagaggguuuaccacgcauuuacagcggug

SEQ ID NO: 4253789 - RNA, 85 nt, Yersinia pestis
uggaaugcuaugacgugacauuaauuuaugacgcuacauuaauucauaacguuacguuaauugauguuacguuccauagaaaaca

SEQ ID NO: 4253790 - RNA, 85 nt, Yersinia pestis
guuaugcacugcagaguaucggugaguugaugaucuccggcuuaggucuggccaugguugcucaauugguaccucagcguuuaau

SEQ ID NO: 4253791 - RNA, 83 nt, Yersinia pestis
gguagauacucgcccaggcaucaugcaguaacuccccugaaagacuccacaucagccaguuugauguuucuggguuauaggcu

SEQ ID NO: 4253792 - RNA, 63 nt, Yersinia pestis
gauugauuuuguaaaccaauuggaacuauuuaaauuaaauuuuccaguugguuaaugucaguu

SEQ ID NO: 4253793 - RNA, 57 nt, Yersinia pestis
accgaguuuuugugccaaaccaaucauaccgcgguuauuuggcauggugacugcggu

SEQ ID NO: 4253794 - RNA, 71 nt, Yersinia pestis
augggcuuggucucggguaauuaacucuuuuaaugcauuaaaugagguuuuuacuugaggcuguagcccau

SEQ ID NO: 4253795 - RNA, 72 nt, Yersinia pestis
agcggcaagucaaaaaauaucacugaacauaaaggaguauaaaauguucagucguauacugauauuaucguu

SEQ ID NO: 4253796 - RNA, 67 nt, Yersinia pestis
ccaguucuuauuguuugguauaucuuccgggugaucucgggagguuccccaacaacaaaaguccugg

SEQ ID NO: 4253797 - RNA, 62 nt, Yersinia pestis
gcgcuugggguuuguaacggcugucagaugaugucuaaucugcgugaauuaaucccaggugc

SEQ ID NO: 4253798 - RNA, 72 nt, Yersinia pestis
gguaagacuauuuuacucuuuucuggcguucauucugcaauugacgcauugaaaaguaauaaguuuuuaacc

SEQ ID NO: 4253799 - RNA, 64 nt, Yersinia pestis
guggcggaaugcgcggcaucacacacggcacgguuccuuaagccaauguugcagcguaagccac

SEQ ID NO: 4253800 - RNA, 68 nt, Yersinia pestis
ucuggaaaguaguucaaugacguugggccuggucuggggcgcaauuggguugagcuauauggucugga

SEQ ID NO: 4253801 - RNA, 63 nt, Yersinia pestis
ccgauacguugcgauuggaaaccgacuuagcaugugcguuggcugccagccgcgauguguugg

SEQ ID NO: 4253802 - RNA, 73 nt, Yersinia pestis
ucauagccguucauuaacggucgccauccuacgagaaaucggguggaacggcaccuuagugaaaacguuacga

SEQ ID NO: 4253803 - RNA, 57 nt, Yersinia pestis KIM; identical to SEQ ID NO: 4253748

SEQ ID NO: 4253804 - RNA, 58 nt, Yersinia pestis KIM
ggcgggcaacgggggauuuuuacagccggugugcuggaugaauuccaucgugcucgcu

SEQ ID NO: 4253805 - RNA, 57 nt, Yersinia pestis KIM
gaacgguaacgguauaggcgaagacgaaacguuccucuucggguaucgauugcguuu

SEQ ID NO: 4253806 - RNA, 68 nt, Yersinia pestis KIM; identical to SEQ ID NO: 4253042

SEQ ID NO: 4253807 - RNA, 68 nt, Yersinia pestis KIM; identical to SEQ ID NO: 4253312

SEQ ID NO: 4253808 - RNA, 99 nt, Yersinia pestis KIM
aacagcuucaaaaaaaugagcuuugacuucugauucagcgaguugcuguucaaguucuuuaauucgcuguucgggaguaagaggcauuuuaggcauguu

SEQ ID NO: 4253809 - RNA, 74 nt, Yersinia pestis KIM; identical to SEQ ID NO: 4253125

SEQ ID NO: 4253810 - RNA, 58 nt, Yersinia pestis KIM
gaagcauuacugcgugagauccagcaacaacgucuggaucucgcggacagugcugcuc

SEQ ID NO: 4253811 - RNA, 59 nt, Yersinia pestis KIM
aauuuaacaaaagaucauguuggccguuuagcggaacacgauaugaguuuugaugaauu

SEQ ID NO: 4253812 - RNA, 78 nt, Yersinia pestis KIM
guggugcugaugaagggaucgaacugcugauccgcgcguucugugagccgggucaggaugccauuuuauucugcccac

SEQ ID NO: 4253813 - RNA, 70 nt, Yersinia pestis KIM
guuuuuuuaucgagugcauagugcguguauugcccggucagcggcagcgcaucaaugccuuuaaagaaac

SEQ ID NO: 4253814 - RNA, 61 nt, Yersinia pestis KIM; identical to SEQ ID NO: 4253209

SEQ ID NO: 4253815 - RNA, 70 nt, Yersinia pestis KIM
cgaacaagguaaucgcauugauugguaugcucccuucgaggggaaagucaccucauggauugccgccucg

SEQ ID NO: 4253816 - RNA, 77 nt, Yersinia pestis KIM; identical to SEQ ID NO: 4253689

SEQ ID NO: 4253817 - RNA, 55 nt, Yersinia pestis KIM
aaggccucugcuucauacagcaugguauuaauaugcugugguugcgucaggucuu

SEQ ID NO: 4253818 - RNA, 69 nt, Yersinia pestis KIM
gugcuuuaagauuuauguuuggacacgcagcuuauuauggcguauugggucagaugaaucggggagcgc

SEQ ID NO: 4253819 - RNA, 56 nt, Yersinia pestis KIM
gaaugugguuggccugcgcaucgccggugaugucggugugacccgccaccacgauc

SEQ ID NO: 4253820 - RNA, 88 nt, Yersinia pestis KIM
gcgggauggauuuugauguugauuggcgcacugcgucuaagaaaaagggcagaacgccaugaauaauaaaauugcuuuauauugccgc

SEQ ID NO: 4253821 - RNA, 55 nt, Yersinia pestis KIM
cacugcuccagcgccauuaaugucuuacccgcgaccguaacuggcuguagcggug

SEQ ID NO: 4253822 - RNA, 74 nt, Yersinia pestis KIM
cguuauuuuaauuuuaccugauugaagguugagaauauggccucaacaucagcacuggugagauuauguuggcg

SEQ ID NO: 4253823 - RNA, 84 nt, Yersinia pestis KIM; identical to SEQ ID NO: 4253630

SEQ ID NO: 4253824 - RNA, 56 nt, Yersinia pestis KIM
gggauaaaguugcuguuuaaucaaugccaauguggcaaacagcagggcauuauccc

SEQ ID NO: 4253825 - RNA, 86 nt, Yersinia pestis KIM; identical to SEQ ID NO: 4253537

SEQ ID NO: 4253826 - RNA, 78 nt, Yersinia pestis KIM
gcuuaucaaguauauuuuguuuggcugaucucuauaauccugacucagacagagaggaauaugaacuugacgauaagc

SEQ ID NO: 4253827 - RNA, 63 nt, Yersinia pestis KIM
uugggcgauuaccaaugggaacaguuuacucaguauuuaacuucucgcggguugaccgcccaa

SEQ ID NO: 4253828 - RNA, 87 nt, Yersinia pestis KIM; identical to SEQ ID NO: 4253779

SEQ ID NO: 4253829 - RNA, 61 nt, Yersinia pestis KIM
cauccugagaggcuugcaguaaaagcccaucuuugucauuaacugcacgcaucucaguuug

SEQ ID NO: 4253830 - RNA, 109 nt, Yersinia pestis KIM; identical to SEQ ID NO: 4253503

SEQ ID NO: 4253831 - RNA, 57 nt, Yersinia pestis KIM; identical to SEQ ID NO: 4253047

SEQ ID NO: 4253832 - RNA, 72 nt, Yersinia pestis KIM; identical to SEQ ID NO: 4253798

SEQ ID NO: 4253833 - RNA, 87 nt, Yersinia pestis KIM
ccccgaaauaacgguucaucagugcgauugagccccccagccugacagcucuguucaguuguuccugacgccuguuuuccucguggg

SEQ ID NO: 4253834 - RNA, 75 nt, Yersinia pestis KIM
cgguauggcggcgucaaugcgcgggcaguuugacgcgauugugggcuugcugggcauugagccguuauugaaccg

SEQ ID NO: 4253835 - RNA, 76 nt, Yersinia pestis KIM
aucgcaucuugcugaugaaugguuagcuuaucuuucaguugaggauggcuagccagccgugcagccagaucgcgau

SEQ ID NO: 4253836 - RNA, 111 nt, Yersinia pestis KIM
uuugaauucugucaguuuuuccaaggcuauauuggugaccggcgcaccuaacucucugccaguaacaugcccauucacaauguggaucacggaacgaugaagaucuucaaa

SEQ ID NO: 4253837 - RNA, 129 nt, Yersinia pestis KIM
uuuaauaagcgcuggcguaccaugucauugaucgcguuauuggcacguaccgugacgguuuccgucgucugcucaaaaccuuuacugacgugacgaaaugcaucaaccaacucgccuucgcucauuuca

SEQ ID NO: 4253838 - RNA, 80 nt, Yersinia pestis KIM; identical to SEQ ID NO: 4253347

SEQ ID NO: 4253839 - RNA, 78 nt, Yersinia pestis KIM
guuuuagcugguaagcgugucaauucucgcucugcucaggcagagcgauaaccaugacgccuuuauuagaguuaaagc

SEQ ID NO: 4253840 - RNA, 78 nt, Yersinia pestis KIM; identical to SEQ ID NO: 4253017

SEQ ID NO: 4253841 - RNA, 66 nt, Yersinia pestis KIM
cuggaagcgcuggauccggauucauugucaccgcgucaggcacuggaguggaucuaucgcuugaag

SEQ ID NO: 4253842 - RNA, 79 nt, Yersinia pestis KIM; identical to SEQ ID NO: 4253079

SEQ ID NO: 4253843 - RNA, 64 nt, Yersinia pestis KIM
cgugauauugcuggcgugcgucuggcugccagugaggucgacgcggcucccggauaaugucaug

SEQ ID NO: 4253844 - RNA, 65 nt, Yersinia pestis KIM
gcuauuggaugaagugcagucaauuugcccaccgggugugacaauaaugcauauucgucaggggc

SEQ ID NO: 4253845 - RNA, 83 nt, Yersinia pestis KIM; identical to SEQ ID NO: 4253075

SEQ ID NO: 4253846 - RNA, 78 nt, Yersinia pestis KIM
aagaaagccagcuaaucugauggcgaucucgccugauauuauuuggugauaucgcuggcugguuaguguggcugccuu

SEQ ID NO: 4253847 - RNA, 130 nt, Yersinia pestis KIM
cguugggaacagggccugauacauggcgucggaggcaguaagaauaggcugcucaugguagagggugucuuguaauguaggagcgauguuuucugucacgccaaguagaaagaugcccuguucaguuaug

SEQ ID NO: 4253848 - RNA, 99 nt, Yersinia pestis KIM
uggccugucguuagcucuuccgguauuucucuggaugagaccgcacuggaaagaucuucucaaauuagaaaaugccgcucagagacugggcucaggcca

SEQ ID NO: 4253849 - RNA, 56 nt, Yersinia pestis KIM
uugccgauaugaacgagguucuuguugaucaaccuguaacccgaacguauuggcaa

SEQ ID NO: 4253850 - RNA, 67 nt, Yersinia pestis KIM
guggcacaucuggucgcguugcaggaggaacucguucagauccaaggcaacgcgccgcugcugucgc

SEQ ID NO: 4253851 - RNA, 93 nt, Yersinia pestis KIM
ggcgcauugcgcuggcgcgcuucgauguggcaauaaauuugaaccacaaugguaaguuaauucgccaauaucgugcggcaccagacccugccc

SEQ ID NO: 4253852 - RNA, 67 nt, Yersinia pestis KIM
uuaaucgacaaguuacuguucugggaucauugauuaauaccgcgcccuccgcagaacuuacgguuaa

SEQ ID NO: 4253853 - RNA, 98 nt, Yersinia pestis KIM
cugcucuaaaccaugcggugagcuguagugggugagcgcauuaugggugaaccagugcauggcgugauucagcuucugcgcuugcugcggugcagcag

SEQ ID NO: 4253854 - RNA, 82 nt, Yersinia pestis KIM
agggggccacgcuuugcacugaaccccagaucuuggaucuuuuuauccaugaucuggagguucgguucaaugaaacacccuu

SEQ ID NO: 4253855 - RNA, 100 nt, Yersinia pestis KIM
uaugguuugcgggcacugauuuauauggccucguuaccugauggccaaaugaccaguaucucucagguaacugagguuuauggugucucucgcaaucaua

SEQ ID NO: 4253856 - RNA, 73 nt, Yersinia pestis KIM
guuguucaaaucaugauaaaugauggugucaguuuacuggcagcauggcgcauuuaccguggauuuucacaau

SEQ ID NO: 4253857 - RNA, 87 nt, Yersinia pestis KIM
cgucaggccgugauagauggcgauccugucuuagcgaucauugagggcagugucguugcgcaggauggugagagcagcagccugacg

SEQ ID NO: 4253858 - RNA, 83 nt, Yersinia pestis KIM; identical to SEQ ID NO: 4253309

SEQ ID NO: 4253859 - RNA, 95 nt, Yersinia pestis KIM; identical to SEQ ID NO: 4253245

SEQ ID NO: 4253860 - RNA, 70 nt, Yersinia pestis KIM; identical to SEQ ID NO: 4227478

SEQ ID NO: 4253861 - RNA, 128 nt, Yersinia pestis KIM
uguugcuggugaacaacggggccaggccguagcgagaaugaaagaguguuuggaaaacaauaccgaacgccucgaucucgaugagcuugguuugaccucauuacccgauacccugccaccguguaaua

SEQ ID NO: 4253862 - RNA, 55 nt, Yersinia pestis KIM
ucaccagagacguaucuuuuucuacuuaaugaucaggauaaggaagucuugguga

SEQ ID NO: 4253863 - RNA, 61 nt, Yersinia pestis KIM; identical to SEQ ID NO: 4253499

SEQ ID NO: 4253864 - RNA, 63 nt, Yersinia pestis KIM
gugggcuagcaugaaugcaguucaaauuggcacaggccgauuugccauucgcuugcugccuac

SEQ ID NO: 4253865 - RNA, 61 nt, Yersinia pestis KIM; identical to SEQ ID NO: 4253184

SEQ ID NO: 4253866 - RNA, 55 nt, Yersinia pestis KIM
cgcaggaaacgaaccauacgcaguuucauaaccaaauggucaaucaguuccugcg

SEQ ID NO: 4253867 - RNA, 97 nt, Yersinia pestis KIM; identical to SEQ ID NO: 4253226

SEQ ID NO: 4253868 - RNA, 62 nt, Yersinia pestis KIM
gaacgugauccgcagcguuuccuggaagucuuuauucugaaaggccgcgacgaucgacguuu

SEQ ID NO: 4253869 - RNA, 69 nt, Yersinia pestis KIM
uuccugcaacucgaauuauuuaggguauauagucaaaagaaaugauuaugccgguauugauucggggaa

SEQ ID NO: 4253870 - RNA, 127 nt, Yersinia pestis KIM
ccgcccucguauucagccucgggaucaugggggcuuaugcucaacggagccaaucgauuguuacugucguuaaaguuauuggugaaccuugguauacccgcaugggggaaggggcuaaagaguuugg

SEQ ID NO: 4253871 - RNA, 116 nt, Yersinia pestis KIM
ccgcuggugacggcuuuauaguccuuccaugacacauauuucaggcuguugcguaccauauggaugaugcacagcuggaugugagucugcggauaaacacuguuuaucgcauccgg

SEQ ID NO: 4253872 - RNA, 95 nt, Yersinia pestis KIM
agcuaauagguugucaugagcaucgguaaccaacgcuugugcaauguuaccggcuuuaccauucgcaagcugguuauccaagaacgacguuagcu

SEQ ID NO: 4253873 - RNA, 101 nt, Yersinia pestis KIM; identical to SEQ ID NO: 4252969

SEQ ID NO: 4253874 - RNA, 58 nt, Yersinia pestis KIM; identical to SEQ ID NO: 4253434

SEQ ID NO: 4253875 - RNA, 57 nt, Yersinia pestis KIM
cgccccgaugaagcauuagcauggcagugagucuucuugcguaaucuuuaucgcgcg

SEQ ID NO: 4253876 - RNA, 56 nt, Yersinia pestis KIM
cuugcgugaacgggcugaagaugaggcuauuaaugucuuugcccguaauaugcaag

SEQ ID NO: 4253877 - RNA, 64 nt, Yersinia pestis KIM
uaugccguaugaagauaaggggaaaaguacauuaauugacuccuuugguuuuauuuuaggcaua

SEQ ID NO: 4253878 - RNA, 129 nt, Yersinia pestis KIM
auuguuuuuauggacauuuuuuuauggauauuguuauuuguagacauuguuauugguagauauuuuuuuauaaaacuuguuguuuauaaacguuauuguuuauaaaaauuauuguuuaugaagguuauu

SEQ ID NO: 4253879 - RNA, 118 nt, Yersinia pestis KIM
gcuggcgagguaccgcugcccggcucaucaaggauaagcaguucuggcucugcgaccaaggcucuggcaauggcuagcuguuguuguugauuacgggucagcucaccaccucguuggc

SEQ ID NO: 4253880 - RNA, 63 nt, Yersinia pestis KIM
gugaauaaugcuaacaccaucggcauuauauguuucuccggugaccuguauuucauuauucac

SEQ ID NO: 4253881 - RNA, 113 nt, Yersinia pestis KIM
gcaguuagccaacaaaugcaacgguuagaacaguuagucgguaaggaguuauuugcccgccacgggcguaacaaauuacucacugaacauggucuccagcuacuuggcuaugc

SEQ ID NO: 4253882 - RNA, 88 nt, Yersinia pestis KIM
ccauuaaagucagugagcguaaugguaagguugucggugcuguucaaguugcaccaacugaccaaaucaugaugaucacugaugcugg

SEQ ID NO: 4253883 - RNA, 74 nt, Yersinia pestis KIM
gccaucgagaacaguauuuccccggcagugacugaugaguuggcgacugcugucggcaauacuucaccgauggc

SEQ ID NO: 4253884 - RNA, 57 nt, Yersinia pestis KIM; identical to SEQ ID NO: 4253768

SEQ ID NO: 4253885 - RNA, 86 nt, Yersinia pestis KIM
gcuguuaacacgauggcaacauucagcggaacggauauauacccuaaauaauucgaguuauugaauguagccaacguacaugcagc

SEQ ID NO: 4253886 - RNA, 120 nt, Yersinia pestis KIM
ucaacuggcaaagcgccaaaugaccugguugcggggcuggaguucaguucaauggcucgacagugauaagccgggagaggcuuuagacuccguaauacagguuguuagugcauagguuga

SEQ ID NO: 4253887 - RNA, 130 nt, Yersinia pestis KIM; identical to SEQ ID NO: 4227246

SEQ ID NO: 4253888 - RNA, 56 nt, Yersinia pestis KIM
uuggcgcugauaacuaaacuuugaauugacugaaucgugcugguuguuugugccaa

SEQ ID NO: 4253889 - RNA, 79 nt, Yersinia pestis KIM
ggggcggcggcugguguacagcacgggcauacugaaaccaaaaugugcccguugggcuaacgccaugccaauacggccc

SEQ ID NO: 4253890 - RNA, 64 nt, Yersinia pestis KIM
uuuuacaagaugcagcaggccugcccggauaaagaguuguuugaagcaccuacugcaggugaag

SEQ ID NO: 4253891 - RNA, 79 nt, Yersinia pestis KIM; identical to SEQ ID NO: 4253444

SEQ ID NO: 4253892 - RNA, 98 nt, Yersinia pestis KIM; identical to SEQ ID NO: 4253286

SEQ ID NO: 4253893 - RNA, 64 nt, Yersinia pestis KIM
ugccaacaggaaggucucacauugaucguccaaaugcugggcggucaguaagacuucuuuggca

SEQ ID NO: 4253894 - RNA, 55 nt, Yersinia pestis KIM
aguggucaaauggugcgcuuaagagaaggauguaacgcagccgauagagaccgcu

SEQ ID NO: 4253895 - RNA, 85 nt, Yersinia pestis KIM; identical to SEQ ID NO: 4253594

SEQ ID NO: 4253896 - RNA, 98 nt, Yersinia pestis KIM; identical to SEQ ID NO: 4253470

SEQ ID NO: 4253897 - RNA, 66 nt, Yersinia pestis KIM
gguaaugauauugucucauuuauugauagugauaccaacagugucauuauaacgaaugugacaacc

SEQ ID NO: 4253898 - RNA, 85 nt, Yersinia pestis KIM
gacccacguuaagugaauugcggcagcggaaucagucuuauauucaaucggaacugaaaaccggcggcaauuuauugcguuucuc

SEQ ID NO: 4253899 - RNA, 70 nt, Yersinia pestis KIM
aggauaguugcugauugcucaaccagcuuggucuuaaugucaugcuguuguugcaaaucgguaguguccu

SEQ ID NO: 4253900 - RNA, 78 nt, Yersinia pestis KIM; identical to SEQ ID NO: 4253370

SEQ ID NO: 4253901 - RNA, 108 nt, Yersinia pestis KIM
cugugcuauaguccuuauaaguucagaguuuaucuucguagguuuacaguuugucuuuucugcugagagcuuaccggguuaaacuuuuccgggaggauuauugugcag

SEQ ID NO: 4253902 - RNA, 69 nt, Yersinia pestis KIM
gguggugauauguaacuguucuugcagugucggcgcggcaacagcaauggcauuacguguuaaguaacc

SEQ ID NO: 4253903 - RNA, 75 nt, Yersinia pestis KIM
acccacgcggguauggcggcagaggcgcguauugccgcaggcauuacugauaguuuguugcguauuuccgugggu

SEQ ID NO: 4253904 - RNA, 55 nt, Yersinia pestis KIM
gauuacagcuauuauucugcgccaucuuguggcagcugugaugauaacugugauu

SEQ ID NO: 4253905 - RNA, 85 nt, Yersinia pestis KIM; identical to SEQ ID NO: 4253439

SEQ ID NO: 4253906 - RNA, 55 nt, Yersinia pestis KIM
aauaacagaaacucagcauuuaacacugauuaguguugcugagauugugcuuguu

SEQ ID NO: 4253907 - RNA, 76 nt, Yersinia pestis KIM
augcugauauugaguuacuuuucagaaggcagauguguugacuacauucugaaaucuaugagguguaaauaagcau

SEQ ID NO: 4253908 - RNA, 79 nt, Yersinia pestis KIM
ucacgaguacuggcggguuggaaaguaaauauaucuugcaaaacaacauguucaccuuccauucccaugaucucgcuga

SEQ ID NO: 4253909 - RNA, 65 nt, Yersinia pestis KIM
uacauggcagaaggugauuaucggggcguuuauuaucgccgccgguagcgccuuugguuggcgua

SEQ ID NO: 4253910 - RNA, 129 nt, Yersinia pestis KIM
caaccacguccgcauucugauacauaccccagacagauaaauccaucgccagcuuuugugguacuggagccguaacgggcugaaccauaggggccgguauugauucugagguuaaugcugaugcugaug

SEQ ID NO: 4253911 - RNA, 57 nt, Yersinia pestis KIM
auuacggauauucagguuuucacgcucaauccgcugcguguaaagcuugcuccugau

SEQ ID NO: 4253912 - RNA, 78 nt, Yersinia pestis KIM; identical to SEQ ID NO: 4253488

SEQ ID NO: 4253913 - RNA, 67 nt, Yersinia pestis KIM; identical to SEQ ID NO: 4253030

SEQ ID NO: 4253914 - RNA, 62 nt, Yersinia pestis KIM
gcggguauuggcgcauuuauugugggaaauaacgguaaagcaauaaaagccacaaugcgugc

SEQ ID NO: 4253915 - RNA, 58 nt, Yersinia pestis KIM
accauggugacaaagagauagcugugcauaucguaccagucaugccuuuuaucauggu

SEQ ID NO: 4253916 - RNA, 71 nt, Yersinia pestis KIM
uagguucguaguuaugaucugccagauuacugucaaucuguggucgggcaccguauaccacgacuaaucug

SEQ ID NO: 4253917 - RNA, 62 nt, Yersinia pestis KIM; identical to SEQ ID NO: 4253314

SEQ ID NO: 4253918 - RNA, 92 nt, Yersinia pestis KIM
guggcgaucauaugguucagguagauuucgcgcccuucaaucucaaguucaccggcggggagggccgcuaaauccauuuggcugauugccgc

SEQ ID NO: 4253919 - RNA, 64 nt, Yersinia pestis KIM; identical to SEQ ID NO: 4253256

SEQ ID NO: 4253920 - RNA, 80 nt, Yersinia pestis KIM
auauucagaugcgugaauuaucuaaugaaacucgugaaacuauucacuugggugcauuggaugaagauagcauuguguau

SEQ ID NO: 4253921 - RNA, 55 nt, Yersinia pestis KIM
ccucggcaaguugugguaggaagugcaaggcaauuuuuugcugccauugccacgg

SEQ ID NO: 4253922 - RNA, 61 nt, Yersinia pestis KIM
gcucaugaguuaaugcgucucggccugugguacagaccuauuuaugcacgacaucuugagu

SEQ ID NO: 4253923 - RNA, 55 nt, Yersinia pestis KIM; identical to SEQ ID NO: 4252982

SEQ ID NO: 4253924 - RNA, 80 nt, Yersinia pestis KIM
ucagcaaacacugaaucuccaacagcgacggguacaaaauucaccgccuggcgcugaugauuauuacagugcuauucuga

SEQ ID NO: 4253925 - RNA, 69 nt, Yersinia pestis KIM
gcagaaaccggcaauuuauccaauaugaccaguuuagcuggcaccauauaguccgguaauuguugcugc

SEQ ID NO: 4253926 - RNA, 67 nt, Yersinia pestis KIM
gguauauugcuugcaggugcugcggguaacgaugucguuggcccauuggcaguugaaguaauauucc

SEQ ID NO: 4253927 - RNA, 70 nt, Yersinia pestis KIM
ggagcgcauuaaccacuggauaguugccuucugcuuuauauuggcggcuaucaguggauuaggguucuuc

SEQ ID NO: 4253928 - RNA, 102 nt, Yersinia pestis KIM
gccgcucgauaaaauaccaagaucaucuaugcccucacaucugcaacuugaaucugcaacuugaaguaugggggguauaucagggaaauucuauggagcugc

SEQ ID NO: 4253929 - RNA, 65 nt, Yersinia pestis KIM
gcugccgauauuaucgucagacaccagagugauauggcugucgacaagauuaauauuggugaagc

SEQ ID NO: 4253930 - RNA, 58 nt, Yersinia pestis KIM
ucaauauaaaggauagaguuacucuauagucaaugggguagcuaaauguuuaucuuga

SEQ ID NO: 4253931 - RNA, 79 nt, Yersinia pestis KIM; identical to SEQ ID NO: 4253413

SEQ ID NO: 4253932 - RNA, 61 nt, Yersinia pestis KIM
gcuggauuugaguggcgguacgcugaucuuugauggugcggugccgcagucucagaccagc

SEQ ID NO: 4253933 - RNA, 80 nt, Yersinia pestis KIM
gccgccucggugacaaaucucugggcgcagggggguuuuaugccccauggcuuucgugguuugaucauggcaauggcggu

SEQ ID NO: 4253934 - RNA, 61 nt, Yersinia pestis KIM; identical to SEQ ID NO: 4253592

SEQ ID NO: 4253935 - RNA, 72 nt, Yersinia pestis KIM
uccgcucuuaggacggggaucaagagaggucaaaccuaaaagagcucguguggaaaccuugccuggggugga

SEQ ID NO: 4253936 - RNA, 93 nt, Yersinia pestis KIM
ugauaaaaccaauuugauuucucugguaggacgugcgcaauaccaauuuacacaauauguacgugcuauuggugaagugggggguuucuauca

SEQ ID NO: 4253937 - RNA, 64 nt, Yersinia pestis KIM
cagcccggugauauugauuuuuaugugguucgggaaaauaccgaaggugaauauucaucgguug

SEQ ID NO: 4253938 - RNA, 57 nt, Yersinia pestis KIM
cggccuuuuugaucauguuuuuccgcuacuggaaacauaaccugaucaauaaagacg

SEQ ID NO: 4253939 - RNA, 61 nt, Yersinia pestis KIM; identical to SEQ ID NO: 4253688

SEQ ID NO: 4253940 - RNA, 105 nt, Yersinia pestis KIM
accgguggcaacgauggaugucggcaccgaguggcuggaaucagaauccucgguaggcuuacuggucccguccacguuggugccgucagaaaacaaccuacuggu

SEQ ID NO: 4253941 - RNA, 84 nt, Yersinia pestis KIM; identical to SEQ ID NO: 4253446

SEQ ID NO: 4253942 - RNA, 61 nt, Yersinia pestis KIM; identical to SEQ ID NO: 4253783

SEQ ID NO: 4253943 - RNA, 68 nt, Yersinia pestis KIM
guagccauuaugucgggaguaauuaauaaucgauaaaaagaauaaguagcuuaugggguaaugguuac

SEQ ID NO: 4253944 - RNA, 114 nt, Yersinia pestis KIM
guuuaauguaccgccagaguuggcauugcaggcaaacaguuuggcgauuaucgcauugguuaucggcugugugguugccggauuggcaauugaccgcuuuggggccaguaaaac

SEQ ID NO: 4253945 - RNA, 64 nt, Yersinia pestis KIM; identical to SEQ ID NO: 4253341

SEQ ID NO: 4253946 - RNA, 55 nt, Yersinia pestis KIM
ccuuguaaaaaauacgccauuucguuaauaugaaacgguguucuguuuuuuaugg

SEQ ID NO: 4253947 - RNA, 69 nt, Yersinia pestis KIM
guaguggaaguuaugguucuggacaucgaugaagaacgucgucguauuucucugggccugaaacagugc

SEQ ID NO: 4253948 - RNA, 61 nt, Yersinia pestis KIM; identical to SEQ ID NO: 4253222

SEQ ID NO: 4253949 - RNA, 59 nt, Yersinia pestis KIM; identical to SEQ ID NO: 4252976

SEQ ID NO: 4253950 - RNA, 56 nt, Yersinia pestis KIM; identical to SEQ ID NO: 4253243

SEQ ID NO: 4253951 - RNA, 68 nt, Yersinia pestis KIM
ggcauaccugcagacuauauucuggcaaaugcuaaugggauuagcugucagggauguaguuuugcgcc

SEQ ID NO: 4253952 - RNA, 80 nt, Yersinia pestis KIM
agguuuggcccucacguucaccacgguaaaaggcgauaagugcugccagugcaaaggucagacguggggguaauuggccu

SEQ ID NO: 4253953 - RNA, 74 nt, Yersinia pestis KIM
gcccuucugcggaucugaacauucuccggcaacugacagagaacguguugcuguucaaugauacccaagagggc

SEQ ID NO: 4253954 - RNA, 64 nt, Yersinia pestis KIM
caguggauagcgaccaucgagacguacuccagcauggagagcgacugcauggucgcuguagcug

SEQ ID NO: 4253955 - RNA, 59 nt, Yersinia pestis KIM
gcaaugaucacacgggguauagcgaacugugcacgcuguuucucgauccugauuaucgc

SEQ ID NO: 4253956 - RNA, 86 nt, Yersinia pestis KIM
accggguuggucuugaugacugacgaugggcaguggucacaucgcgucacuucgccacgucaucauugugaaaagaccuauuuggu

SEQ ID NO: 4253957 - RNA, 59 nt, Yersinia pestis KIM
ccggugcgcauuaccgaucccggcgggcgcuucuggcggcagagcugggaugcgcaagg

SEQ ID NO: 4253958 - RNA, 62 nt, Yersinia pestis KIM
uacgcuaauuuauacgucggguaccacgggggagccaaaaggcgugauguuggauuaccgua

SEQ ID NO: 4253959 - RNA, 59 nt, Yersinia pestis KIM; identical to SEQ ID NO: 4252955

SEQ ID NO: 4253960 - RNA, 77 nt, Yersinia pestis KIM
auggccaguuagcgcuauaugauuuaaucgaacaacuacgaaaagaguuagguugugcuguguuaaugguuucccau

SEQ ID NO: 4253961 - RNA, 115 nt, Yersinia pestis KIM
ugcugcugaguuggauuuucuggcaauggaaucaggauguggcugagauucaguucgguaucaccacugacuugauuacccaucugcuuagccagagauucaacuucuugcggca

SEQ ID NO: 4253962 - RNA, 58 nt, Yersinia pestis KIM; identical to SEQ ID NO: 4253528

SEQ ID NO: 4253963 - RNA, 85 nt, Yersinia pestis KIM
ccaucccucaacgugacuauugauauguugugcggugauagcgauacaucugcugcgauacagcuuauuaauaucauggagaugg

SEQ ID NO: 4253964 - RNA, 70 nt, Yersinia pestis KIM
cggcguugagcgccgcuugcaccgccgugaacuggcuuauauggauggugacgaacugcguucaaugucg

SEQ ID NO: 4253965 - RNA, 61 nt, Yersinia pestis KIM
gaauaaauacuggccaaccguaaagcgucuggaugauguuuacggugaucggaauuuguuc

SEQ ID NO: 4253966 - RNA, 60 nt, Yersinia pestis KIM
cagggucaguuggugguacaucaccgcgaccugcuuuuugucaucgccgaacugauuuug

SEQ ID NO: 4253967 - RNA, 57 nt, Yersinia pestis KIM; identical to SEQ ID NO: 4253662

SEQ ID NO: 4253968 - RNA, 56 nt, Yersinia pestis KIM
cuguauauaaaaccagucuauacuguguucaaauacagacauguguuuauguacag

SEQ ID NO: 4253969 - RNA, 85 nt, Yersinia pestis KIM
gccagguuagucgcuauacgcaaauccgggcuugggaucaggaaaucaucccucuggcugagcguaucagcgaauggcgagcggc

SEQ ID NO: 4253970 - RNA, 68 nt, Yersinia pestis KIM
agugguguugcuguggaucugucuucacaaggcaugcguguggagauggcaucguuggcgacauuauu

SEQ ID NO: 4253971 - RNA, 78 nt, Yersinia pestis KIM; identical to SEQ ID NO: 4252949

SEQ ID NO: 4253972 - RNA, 72 nt, Yersinia pestis KIM
ucauuucugcuagcaauaucugcguauugguaucggccccuucauuaagcaggcuuugcuguagugcauuga

SEQ ID NO: 4253973 - RNA, 95 nt, Yersinia pestis KIM
ucgcuuuaucgaccucuuuuuccagugccgccuuugccauuaaacacagggguugaguggcaucaaacaguuggaaauagaggcccgaaaggcga

SEQ ID NO: 4253974 - RNA, 78 nt, Yersinia pestis KIM; identical to SEQ ID NO: 4252989

SEQ ID NO: 4253975 - RNA, 111 nt, Yersinia pestis KIM
gaaggccucacccgugagcagcaugaucaacaguugauugagaaaauugaacaauaucaaccagauuauguuguucuggcuaaauauaugcgggugcuaacaccggccuuu

SEQ ID NO: 4253976 - RNA, 80 nt, Yersinia pestis KIM
gcacaaaucgaacguuugagccaaccgagcggggcugaagaugcccgcuuaaucgcgcuggcugaacguuuuggcggugu

SEQ ID NO: 4253977 - RNA, 57 nt, Yersinia pestis KIM
uuaccgucuacccguggaagcgguaccuauucgcuuuacuucauggaugggcgguga

SEQ ID NO: 4253978 - RNA, 73 nt, Yersinia pestis KIM; identical to SEQ ID NO: 4253661

SEQ ID NO: 4253979 - RNA, 64 nt, Yersinia pestis KIM
uuuggcgcgucguuuuuagugucgcaaugugaugcacugagauaaaaaggaugacugagugaaa

SEQ ID NO: 4253980 - RNA, 56 nt, Yersinia pestis KIM
ggccagucaaggggucuaugauuucucacaugaagucaaagaauccaugucuggcu

SEQ ID NO: 4253981 - RNA, 84 nt, Yersinia pestis KIM
aguuuugaucuuugguggccagaagguugaaaccgagcgcuuugaugcugucaguaaccguaugcgccagcaggggaugaaacu

SEQ ID NO: 4253982 - RNA, 76 nt, Yersinia pestis KIM; identical to SEQ ID NO: 4253307

SEQ ID NO: 4253983 - RNA, 74 nt, Yersinia pestis KIM
cccguugaccguaagauauacagccagaauccgguaagaugcugcaaucagguuuaauuuaugggucgaugagg

SEQ ID NO: 4253984 - RNA, 64 nt, Yersinia pestis KIM
gauuuacggacuauccagccgcgcggcgaccucccgcuagucggccgggaguucguauuagguc

SEQ ID NO: 4253985 - RNA, 63 nt, Yersinia pestis KIM; identical to SEQ ID NO: 4253717

SEQ ID NO: 4253986 - RNA, 129 nt, Yersinia pestis KIM
agcaagucuggccccucuucaccagucacugacgaucauuuuggacuuaauucgccagucaugcccuuuacguagccagauaaguuuaaaugguuucuuucaggauaaugcugggggagcugaccugcu

SEQ ID NO: 4253987 - RNA, 59 nt, Yersinia pestis KIM
ggaacucgaugaaaauuaguuuuuugaccauggucuuaacgcugaucagugucaguuuc

SEQ ID NO: 4253988 - RNA, 62 nt, Yersinia pestis KIM
gcuuuggccauaacacaauauuagugcccguggggguaagauuuuuuguuaugugcuucugc

SEQ ID NO: 4253989 - RNA, 78 nt, Yersinia pestis KIM
cgucaacggaauauuguuacggugguggugguacaugacauuaauauugccuugcgccauggugaucauguccugaug

SEQ ID NO: 4253990 - RNA, 85 nt, Yersinia pestis KIM
gguagaagucugacggauaguagccugacagauagaagggccugcaaucgcaggccuuuuuagucaggguauuucgccugauacc

SEQ ID NO: 4253991 - RNA, 79 nt, Yersinia pestis KIM
gcuaaauuuguuaggaauuaaaccugaaaaugagcaugcuuuugcugaccaucaggauuauucauuggcacaauuaagc

SEQ ID NO: 4253992 - RNA, 59 nt, Yersinia pestis KIM; identical to SEQ ID NO: 4253585

SEQ ID NO: 4253993 - RNA, 64 nt, Yersinia pestis KIM
gcaagguguuuuccaacgccugacgcaauaacucgcggucauggcggugaggaauaucuuuugc

SEQ ID NO: 4253994 - RNA, 59 nt, Yersinia pestis KIM; identical to SEQ ID NO: 4253325

SEQ ID NO: 4253995 - RNA, 65 nt, Yersinia pestis KIM
auagcgauaaaaaagguugaguucaggugagaaaguauuuguaauccaaccaauuuuauugguau

SEQ ID NO: 4253996 - RNA, 129 nt, Yersinia pestis KIM
gcugauucugguggugguugggcgaucgaucagucugcacaggcauuugauuuaugaauggcuacaacgucgucgcagucgaaaggccucugcgugauaccuaaacccaacacccaacacccaacaccc

SEQ ID NO: 4253997 - RNA, 78 nt, Yersinia pestis KIM
ggaggauggcuggcgaguugagggagucuguucgcuacaccaucaagauaggcaacuucaauuaugcggcacaauucc

SEQ ID NO: 4253998 - RNA, 57 nt, Yersinia pestis KIM
aucauugauggcguacgguuauguaaagccaagcguuaucguuaugccaacaaugau

SEQ ID NO: 4253999 - RNA, 109 nt, Yersinia pestis KIM; identical to SEQ ID NO: 4253512

SEQ ID NO: 4254000 - RNA, 59 nt, Yersinia pestis KIM
aagucgcagaugaugcaagggcacacggcuaccgucuugcagcuucgccucugcgaguu

SEQ ID NO: 4254001 - RNA, 67 nt, Yersinia pestis KIM
cauaugauggauaggcccaucgucagguagcgcccaguaagcuaucugacgauuauguuuaucaaug

SEQ ID NO: 4254002 - RNA, 65 nt, Yersinia pestis KIM
ggcgggucaagauguucgugguguagguucguuauugagccuguccauaauucuguguaacugcc

SEQ ID NO: 4254003 - RNA, 124 nt, Yersinia pestis KIM
uaccccucguacuugacguuguagugguguuagccacguucacauacccagaccacugagcugaaucagcguauugggauuugugcguuugcaaccuugccgcaacccccacuuacauugggua

SEQ ID NO: 4254004 - RNA, 94 nt, Yersinia pestis KIM
gccugugcgagcgcggugcuaucuucaucgaggaaauuucagaggugccagauggcuccauucugauuuucucggcccauggugugucacaggc

SEQ ID NO: 4254005 - RNA, 77 nt, Yersinia pestis KIM
gugguuuugauaugaagacaugcuguucccuugaugagagaucgguacaauagcgcuaguuuaucaauuuaugccgc

SEQ ID NO: 4254006 - RNA, 61 nt, Yersinia pestis KIM; identical to SEQ ID NO: 4253569

SEQ ID NO: 4254007 - RNA, 63 nt, Yersinia pestis KIM; identical to SEQ ID NO: 4253707

SEQ ID NO: 4254008 - RNA, 55 nt, Yersinia pestis KIM
ggugggauuauaccuguaauuuuuuaggcuguaucagguuaccguguagucuccc

SEQ ID NO: 4254009 - RNA, 97 nt, Yersinia pestis KIM
gcuaauaacucacuaaauuaacauccgcccgucaauucuauuggccugcccuguuuagcgggucaauagauguuuggcaggucaauagauguuuggc

SEQ ID NO: 4254010 - RNA, 130 nt, Yersinia pestis KIM
aagcuauuaugcacaauauuaugcaaaugaagcgaaugucgaagcagguuuggucgcgacgaaugucgacuauacuaucguuuaugauuaaugcuuguuuaugauuaauacuuguucaugauuaaugcuu

SEQ ID NO: 4254011 - RNA, 67 nt, Yersinia pestis KIM
ugugaacagagucaacuuuuuuaugugaaauacaauuuuucuaaagaagagauugaguuuuuucaua

SEQ ID NO: 4254012 - RNA, 60 nt, Yersinia pestis KIM
ggauaucgcguuacuggcgggcgugacuaaaaugacagucagccgcuauuuacggaugcc

SEQ ID NO: 4254013 - RNA, 125 nt, Yersinia pestis KIM; identical to SEQ ID NO: 4253382

SEQ ID NO: 4254014 - RNA, 71 nt, Yersinia pestis KIM
uucgccaaucagauugacgcggcccggcgcuuuaauggugaugucagacucgcggucaaacuguuggcgga

SEQ ID NO: 4254015 - RNA, 55 nt, Yersinia pestis KIM; identical to SEQ ID NO: 4253234

SEQ ID NO: 4254016 - RNA, 67 nt, Yersinia pestis KIM
uugauacgaagaaggauuucaaucgaaaauaacuucauuucgcaguuuugaaauuuucucguauuga

SEQ ID NO: 4254017 - RNA, 60 nt, Yersinia pestis KIM
ccguaaauagagaaaauagccgcgugccgcugauaucugcggcacacugucuuuauucgg

SEQ ID NO: 4254018 - RNA, 101 nt, Yersinia pestis KIM; identical to SEQ ID NO: 4253539

SEQ ID NO: 4254019 - RNA, 56 nt, Yersinia pestis KIM
acggugggaguugcuuggccagcagaauuaacugacgguagcgauccucccacugu

SEQ ID NO: 4254020 - RNA, 100 nt, Yersinia pestis KIM
ccugugcuuugauuagcauaaaccgcgguugagauugcggaugacagaacagcgucaucccauucucuagccggggcugauaggcugaaaaagcaacagg

SEQ ID NO: 4254021 - RNA, 72 nt, Yersinia pestis KIM; identical to SEQ ID NO: 4253233

SEQ ID NO: 4254022 - RNA, 80 nt, Yersinia pestis KIM
uuuuuaugcauucucuucccauaaauuguauggcccaaccggcauuggcgugcuguaugggaagacugaauuauuagaag

SEQ ID NO: 4254023 - RNA, 93 nt, Yersinia pestis KIM; identical to SEQ ID NO: 4253645

SEQ ID NO: 4254024 - RNA, 66 nt, Yersinia pestis KIM; identical to SEQ ID NO: 4253389

SEQ ID NO: 4254025 - RNA, 62 nt, Yersinia pestis KIM
gaugcugauuuuguacuguucguugccaauuuuguagguugaacagcaguaauaucaguauc

SEQ ID NO: 4254026 - RNA, 70 nt, Yersinia pestis KIM; identical to SEQ ID NO: 4253638

SEQ ID NO: 4254027 - RNA, 88 nt, Yersinia pestis KIM
ucgggccauauacccagacggaacugguuaaaccauaauugcucaucagcaagugguuugacaguuccuuccaccauacugcguccgg

SEQ ID NO: 4254028 - RNA, 101 nt, Yersinia pestis KIM
cgcacaguuuggcggcggaagaccaaccacucagucaggaucucuaacaacccuuugacugaugggcgguuauccaaaccgaucauauucauauugaugcg

SEQ ID NO: 4254029 - RNA, 77 nt, Yersinia pestis KIM
uccaacugaagucgggagaauagcgcgcugauuccgcaauuaauggauaguagcugccaaucucaucgcuugaggga

SEQ ID NO: 4254030 - RNA, 59 nt, Yersinia pestis KIM
uugcaguuuagccagcaacugaucagcuuuuuguuguucguuauggucaugaagugcaa

SEQ ID NO: 4254031 - RNA, 56 nt, Yersinia pestis KIM
cgcuguguaauauaucaccaaucagugcgucccauugauugaguuguucaucagcg

SEQ ID NO: 4254032 - RNA, 65 nt, Yersinia pestis KIM; identical to SEQ ID NO: 4253676

SEQ ID NO: 4254033 - RNA, 62 nt, Yersinia pestis KIM
gaaaucgccagacaacucuagcaaacguccauaacgacaguugcagagaguauggugauagc

SEQ ID NO: 4254034 - RNA, 56 nt, Yersinia pestis KIM; identical to SEQ ID NO: 4253228

SEQ ID NO: 4254035 - RNA, 63 nt, Yersinia pestis KIM
auccauaacauccuaaaaagcgcgaugugacuaucgcgcuuuuuaggauguuucucaggggau

SEQ ID NO: 4254036 - RNA, 61 nt, Yersinia pestis KIM; identical to SEQ ID NO: 4253479

SEQ ID NO: 4254037 - RNA, 78 nt, Yersinia pestis KIM
ggcacugaacagcgggacggucaauaucaccggcucugguagcugggauaacaccgauccgcuggcaacaaauguguc

SEQ ID NO: 4254038 - RNA, 90 nt, Yersinia pestis KIM
guguucgcgcucugauggcauaaaggaaacgguacggacaucuguuaccccaucaauaugccgaaucuccaucauuagugcacugaauau

SEQ ID NO: 4254039 - RNA, 56 nt, Yersinia pestis KIM
augaccguuugugccguuuccccccaauugagggugaacgucgguacgauggucau

SEQ ID NO: 4254040 - RNA, 78 nt, Yersinia pestis KIM
cugaccauuuaccgccauugggcgaucuuugauggcaugcaugccaaggaucgcgcuuugugguggguuaaugaucgg

SEQ ID NO: 4254041 - RNA, 60 nt, Yersinia pestis KIM; identical to SEQ ID NO: 4253094

SEQ ID NO: 4254042 - RNA, 83 nt, Yersinia pestis KIM
gcucagcgccuggcagcgcgaaucguuacacgguaaauuuaaaaccugguuuaacgccguggaacauuugccucaacugacgc

SEQ ID NO: 4254043 - RNA, 57 nt, Yersinia pestis KIM
cugcauuauuuguugagccaaucuuuaucuccuaacgagauucgccaacugaugcag

SEQ ID NO: 4254044 - RNA, 68 nt, Yersinia pestis KIM
uccaugacacauauuucaggcuguugcguaccauauggaugaugcacagcuggaugugagucugcgga

SEQ ID NO: 4254045 - RNA, 109 nt, Yersinia pestis KIM
cuuuagacccacuguaaucauagguauuauucagcugauuaauguucuuuguuuggaaaacguucgguguuuggauaauauuuugugguugaauaauguggcgugaaag

SEQ ID NO: 4254046 - RNA, 72 nt, Yersinia pestis KIM
agaggugacggucuuggcacccgccagcuucaaacaaguggcuuggggcgagacugaagcguuuaucacccu

SEQ ID NO: 4254047 - RNA, 56 nt, Yersinia pestis KIM; identical to SEQ ID NO: 4253473

SEQ ID NO: 4254048 - RNA, 89 nt, Yersinia pestis KIM
gcacagcggggugacagugauaaaacccgccugcaugcugaaauggaaagccugcucagugggcuuaucgcccucgacccggcccgugc

SEQ ID NO: 4254049 - RNA, 79 nt, Yersinia pestis KIM; identical to SEQ ID NO: 4253681

SEQ ID NO: 4254050 - RNA, 83 nt, Yersinia pestis KIM; identical to SEQ ID NO: 4253550

SEQ ID NO: 4254051 - RNA, 90 nt, Yersinia pestis KIM; identical to SEQ ID NO: 4253269

SEQ ID NO: 4254052 - RNA, 64 nt, Yersinia pestis KIM; identical to SEQ ID NO: 4253404

SEQ ID NO: 4254053 - RNA, 55 nt, Yersinia pestis KIM
ucugugcgcccauguucucgaacuugucuuccaguucgauuucacgugcaacaga

SEQ ID NO: 4254054 - RNA, 93 nt, Yersinia pestis KIM
auuaucgacaaacgccgcccacgcgcuaacguuucucaggugaugcauaucaucggggacguugcuggccgugacugcguguuaguugacgau

SEQ ID NO: 4254055 - RNA, 86 nt, Yersinia pestis KIM
cuucgacgagaaaggcaauccgacagaugacccaagcaaggauaaaugcucugggcuguuggucgauugcaaaaaacgauuuggag

SEQ ID NO: 4254056 - RNA, 78 nt, Yersinia pestis KIM
uucgguggcugcggaacgguaucuaccggcgguggcaccucaacauccgguggcguuaccgguucaauggucacugga

SEQ ID NO: 4254057 - RNA, 63 nt, Yersinia pestis KIM
cuguuuuugcaucaacacaugugaaaucuuuagguuauauucacugaguguuugcaguaauag

SEQ ID NO: 4254058 - RNA, 118 nt, Yersinia pestis KIM; identical to SEQ ID NO: 4253053

SEQ ID NO: 4254059 - RNA, 67 nt, Yersinia pestis KIM; identical to SEQ ID NO: 4253504

SEQ ID NO: 4254060 - RNA, 84 nt, Yersinia pestis KIM
augauugguauucgaaaucuggcucacgauaucuuugcgcaguaaggucgccuguaaaguaucgauggccacggguuugaucau

SEQ ID NO: 4254061 - RNA, 102 nt, Yersinia pestis KIM
cgauggagaaacggguacccgcgcggguaaaguuuugcacauauucuggguaaaguacggcuuuggcuaagacuucauuacgcucgggugccagcuucagcg

SEQ ID NO: 4254062 - RNA, 66 nt, Yersinia pestis KIM
gccuagacagacacgcgccauugccgcuacgguuucugccggguacuggccugcugcuguuucugc

SEQ ID NO: 4254063 - RNA, 83 nt, Yersinia pestis KIM
gguuuacggcagcgaucaucagcgguuaauuaauggcgcgacuaggcaccguggcgagacuguugauggcgacuucguuaauc

SEQ ID NO: 4254064 - RNA, 81 nt, Yersinia pestis KIM; identical to SEQ ID NO: 4253388

SEQ ID NO: 4254065 - RNA, 76 nt, Yersinia pestis KIM; identical to SEQ ID NO: 4253682

SEQ ID NO: 4254066 - RNA, 87 nt, Yersinia pestis KIM
gcaccgcuucccccugcucguucaggccacggaucacggcaguauauaaaccauccugcguacugagcgacgguggaaaaucggugu

SEQ ID NO: 4254067 - RNA, 61 nt, Yersinia pestis KIM
uagguauaucugugacaccuccacuaccacaagaagagggagggagcagauuguauaucua

SEQ ID NO: 4254068 - RNA, 70 nt, Yersinia pestis KIM; identical to SEQ ID NO: 4253261

SEQ ID NO: 4254069 - RNA, 80 nt, Yersinia pestis KIM
auuauuuuuugggcuggcguuauacucgugcgcguugcauuugccaacggcuaaccucauagcgcccguagaacaauaau

SEQ ID NO: 4254070 - RNA, 76 nt, Yersinia pestis KIM
caugcucugcgccaguuccccuuccaggcugcgcuuauaacgaacauuuuggauaaacuggcugcugccaagcaug

SEQ ID NO: 4254071 - RNA, 56 nt, Yersinia pestis KIM
gauuggcuggcacagcgugauggccuuaauggcuaccgccugauugccggugaauc

SEQ ID NO: 4254072 - RNA, 72 nt, Yersinia pestis KIM; identical to SEQ ID NO: 4253788

SEQ ID NO: 4254073 - RNA, 60 nt, Yersinia pestis KIM; identical to SEQ ID NO: 4253242

SEQ ID NO: 4254074 - RNA, 70 nt, Yersinia pestis KIM
ccgcugagugcuaacucaauagcugaacugaaaaaacaggcuucagauguugagugggcacgucuggcgg

SEQ ID NO: 4254075 - RNA, 81 nt, Yersinia pestis KIM
gucgguaucuauuuagguaacgauaaauuuguucaugcaucgaccagugccgguguaacgauaucgaaccugaaugacgau

SEQ ID NO: 4254076 - RNA, 82 nt, Yersinia pestis KIM; identical to SEQ ID NO: 4253000

SEQ ID NO: 4254077 - RNA, 68 nt, Yersinia pestis KIM
ggcggcugaguugcaaugacacauuuucacuuucgccccgauaguuguaaucgcuauucaggcccgcc

SEQ ID NO: 4254078 - RNA, 80 nt, Yersinia pestis KIM
gaauauuaucgauauuaucgaacagguauucuccaaauauaacuuugcggauuaccguuuugauaucgucgguaacuauc

SEQ ID NO: 4254079 - RNA, 66 nt, Yersinia pestis KIM
gagcaacgucucggccauuauugcuccuccagauuuaaggggaaaugacaggcaaaggcgugguuu

SEQ ID NO: 4254080 - RNA, 106 nt, Yersinia pestis KIM
guuugaccugcgauauaccagauguuaagccauugaauauuguuauuaaacugguugaauguaacgauaaaccgguggcuaagcucucagauagcccggguaagac

SEQ ID NO: 4254081 - RNA, 96 nt, Yersinia pestis KIM
uacuugcaggagcaugccaccugccgccgcuuuaucggcgacaugcccggugcggauaaacaggcgggucgguaacugcucugacugcaugaagua

SEQ ID NO: 4254082 - RNA, 64 nt, Yersinia pestis KIM; identical to SEQ ID NO: 4253494

SEQ ID NO: 4254083 - RNA, 57 nt, Yersinia pestis KIM
gagcagcguuaugguauucgguuugccgauuauuuugccgaagauuuugagcugcuu

SEQ ID NO: 4254084 - RNA, 60 nt, Yersinia pestis KIM
gcggaacgguggcucauuaaagguacguaauuuacgagaguguaauuggucaccuucugc

SEQ ID NO: 4254085 - RNA, 70 nt, Yersinia pestis KIM
gccgaaucuauaaauuaucacgguccugcaggugcuggccgcuuucugcggaccggaaaauguggaacgc

SEQ ID NO: 4254086 - RNA, 58 nt, Yersinia pestis KIM; identical to SEQ ID NO: 4253358

SEQ ID NO: 4254087 - RNA, 71 nt, Yersinia pestis KIM
ggugaaacguaucauugagcguagcaaugaacuggaaaccagcguugcacguaugcugaauuugggucacc

SEQ ID NO: 4254088 - RNA, 62 nt, Yersinia pestis KIM; identical to SEQ ID NO: 4253394

SEQ ID NO: 4254089 - RNA, 61 nt, Yersinia pestis KIM; identical to SEQ ID NO: 4252963

SEQ ID NO: 4254090 - RNA, 73 nt, Yersinia pestis KIM
gucaugccgguaaaaauggcacacgugaagucguccuggggauggcccaccguggccguuugaacguauugau

SEQ ID NO: 4254091 - RNA, 55 nt, Yersinia pestis KIM
uugagucucagggcgaugccaguagcgccucuggaauugucuugaugagauucaa

SEQ ID NO: 4254092 - RNA, 67 nt, Yersinia pestis KIM
gcaugugaauaagcuugaacaaaacuaugacaacuucauggaagaguucauugcuauucugcaucgc

SEQ ID NO: 4254093 - RNA, 105 nt, Yersinia pestis KIM
cagggugccgagugcuguuaguggacaacgguaagaaagccgggcgcaagauauugauguccggcgguggccguugcaacuuuacgaacauuuauacggaaccug

SEQ ID NO: 4254094 - RNA, 71 nt, Yersinia pestis KIM
gcacaaaccuggcucauuucuucacuccauugcugccauaccccuagcaaguaaugauagaaauguugugu

SEQ ID NO: 4254095 - RNA, 70 nt, Yersinia pestis KIM
gauggaagguguauuagauucgcuggugcgugaauugcucagugaaguaaaugauuacgaccuuugcauc

SEQ ID NO: 4254096 - RNA, 77 nt, Yersinia pestis KIM
cggcagccagccauugcaggucgauguccguuuagucugcgccaccaaugauaaucugcccgcguuggcggcugccg

SEQ ID NO: 4254097 - RNA, 58 nt, Yersinia pestis KIM
cauuggcugaaaugucagauagugaaugggaaucauugugugacggaugcggucaaug

SEQ ID NO: 4254098 - RNA, 72 nt, Yersinia pestis KIM
gacguguugcaguucgcgcaaagugccugguggguugugaccuuccccgguguggcgauccugcuaacaguu

SEQ ID NO: 4254099 - RNA, 60 nt, Yersinia pestis KIM; identical to SEQ ID NO: 4253266

SEQ ID NO: 4254100 - RNA, 92 nt, Yersinia pestis KIM; identical to SEQ ID NO: 4253773

SEQ ID NO: 4254101 - RNA, 92 nt, Yersinia pestis KIM
guuacgucugccgugcgggcaaaucuguguuguacagaggguuuacuuaaccuuuucaagcaauauagauuuugacuggaacgugaugugac

SEQ ID NO: 4254102 - RNA, 102 nt, Yersinia pestis KIM
cuccaguuugcugacaaccaagucgaauugaauggucagaaaaugucaccagaagaauuugcuggccuguuuaaucugcuuggugcacagggagaagaggag

SEQ ID NO: 4254103 - RNA, 72 nt, Yersinia pestis KIM
uugaacauauuccacugccugaucagucgguggauaucugcuuuagcaauuuggcggugcaaugguguucag

SEQ ID NO: 4254104 - RNA, 59 nt, Yersinia pestis KIM; identical to SEQ ID NO: 4253559

SEQ ID NO: 4254105 - RNA, 81 nt, Yersinia pestis KIM
cuggcacccaaugguacccguuuagccgggccacuuaauuucucacugccagcaggcaaacggguugccauugugggucag

SEQ ID NO: 4254106 - RNA, 60 nt, Yersinia pestis KIM; identical to SEQ ID NO: 4253418

SEQ ID NO: 4254107 - RNA, 55 nt, Yersinia pestis KIM
aagauacccugucgauuuuacgcgaagagcaggcgcaggauugcgguggugucuu

SEQ ID NO: 4254108 - RNA, 84 nt, Yersinia pestis KIM; identical to SEQ ID NO: 4252984

SEQ ID NO: 4254109 - RNA, 55 nt, Yersinia pestis KIM; identical to SEQ ID NO: 4227370

SEQ ID NO: 4254110 - RNA, 84 nt, Yersinia pestis KIM
cguauugaggcgaugcgcaaucacaaugaccguuuugucuuuaaugagaucagaaagugcuuguugaaugcggaccucguuacg

SEQ ID NO: 4254111 - RNA, 56 nt, Yersinia pestis KIM
gucaaauugaccgaugcugaucaacaaacaguugacgcugcugucagucguuugac

SEQ ID NO: 4254112 - RNA, 75 nt, Yersinia pestis KIM
guaugaguggucgucgucauucacacccaauguaucgguuaacgaucagggucaggugacgauuaccuaccaaac

SEQ ID NO: 4254113 - RNA, 63 nt, Yersinia pestis KIM
cgugcguugcguucuggucaucaggauuuacugucugaagcacaaccagaaauggagcgcacg

SEQ ID NO: 4254114 - RNA, 75 nt, Yersinia pestis KIM; identical to SEQ ID NO: 4253009

SEQ ID NO: 4254115 - RNA, 102 nt, Yersinia pestis KIM; identical to SEQ ID NO: 4253561

SEQ ID NO: 4254116 - RNA, 129 nt, Yersinia pestis KIM
gacuggguauuccugacggugguuaugcgauugccgcugaucgggcugagaugcgugccuaucaugguuuugaugcggcaggcauuguggcucgugcucugcgguuuugccgaggggaauaacgauguc

SEQ ID NO: 4254117 - RNA, 61 nt, Yersinia pestis KIM
gcucuacauuguugcucgcgagccuggcuuuugcggggcaugcagcgauguaugauggggu

SEQ ID NO: 4254118 - RNA, 102 nt, Yersinia pestis KIM; identical to SEQ ID NO: 4253343

SEQ ID NO: 4254119 - RNA, 55 nt, Yersinia pestis KIM
ggccggaugccaacgcaaccagacucguucgagcaguugugcacugccaucggcc

SEQ ID NO: 4254120 - RNA, 59 nt, Yersinia pestis KIM; identical to SEQ ID NO: 4253694

SEQ ID NO: 4254121 - RNA, 77 nt, Yersinia pestis KIM; identical to SEQ ID NO: 4253043

SEQ ID NO: 4254122 - RNA, 57 nt, Yersinia pestis KIM
uuaucaauuugguggcaucaucacugacuuguaugaacguguucccaauauugauaa

SEQ ID NO: 4254123 - RNA, 81 nt, Yersinia pestis KIM; identical to SEQ ID NO: 4253462

SEQ ID NO: 4254124 - RNA, 56 nt, Yersinia pestis KIM
cauugaaucggaucggugaaucugcacugaguaaugagauugccgccgguucguug

SEQ ID NO: 4254125 - RNA, 70 nt, Yersinia pestis KIM
uuguacgacauuauucauuucgcuuugcggugggauuucccgcacauugaaauagaauaaugucucgcga

SEQ ID NO: 4254126 - RNA, 77 nt, Yersinia pestis KIM; identical to SEQ ID NO: 4253185

SEQ ID NO: 4254127 - RNA, 79 nt, Yersinia pestis KIM; identical to SEQ ID NO: 4253502

SEQ ID NO: 4254128 - RNA, 78 nt, Yersinia pestis KIM
uuguacuacauguugaugaguucuguugaguugcgccaugcgccauucauucuguggauucaugaccugucagcacaa

SEQ ID NO: 4254129 - RNA, 71 nt, Yersinia pestis KIM
ucuggaagagauguggcgcgaucaguucgacuggguauaccgagaacaugauuaugccguauuuaccauga

SEQ ID NO: 4254130 - RNA, 63 nt, Yersinia pestis KIM; identical to SEQ ID NO: 4253108

SEQ ID NO: 4254131 - RNA, 82 nt, Yersinia pestis KIM; identical to SEQ ID NO: 4253435

SEQ ID NO: 4254132 - RNA, 92 nt, Yersinia pestis KIM
uuuacacgccgagaaagucgauaguauugauaucacuauucugcugcaaagagucuguuaucaaucugucucgcugccugaaucggccuaaa

SEQ ID NO: 4254133 - RNA, 56 nt, Yersinia pestis KIM
gucaguuaucugcgucgcuugcagguugcgacuuacccgagcgaacggauggugac

SEQ ID NO: 4254134 - RNA, 60 nt, Yersinia pestis KIM
cagcggauccugauagcccacaaucugccccagcacaucguagccguagcggauccguug

SEQ ID NO: 4254135 - RNA, 119 nt, Yersinia pestis KIM
gaagcguuuaagcgucguggccgugaugugucugaauucuccgaaauuguggguguagauguugcagacgccucacuggagggauucaucaaguacgguauucaggcguugagugcuuc

SEQ ID NO: 4254136 - RNA, 58 nt, Yersinia pestis KIM; identical to SEQ ID NO: 4253438

SEQ ID NO: 4254137 - RNA, 57 nt, Yersinia pestis KIM; identical to SEQ ID NO: 4253649

SEQ ID NO: 4254138 - RNA, 120 nt, Yersinia pestis KIM; identical to SEQ ID NO: 4253011

SEQ ID NO: 4254139 - RNA, 130 nt, Yersinia pestis KIM; identical to SEQ ID NO: 4253001

SEQ ID NO: 4254140 - RNA, 56 nt, Yersinia pestis KIM
guugaugagcguguuggccguggaucugaauuagauguuggcccaacucucuuaau

SEQ ID NO: 4254141 - RNA, 88 nt, Yersinia pestis KIM
uugcgauuauuugcucagauuaucaggccaguaaacgguucuacugugaggugcuagguuuuaaucugaucagcgagguuuaucgcga

SEQ ID NO: 4254142 - RNA, 108 nt, Yersinia pestis KIM; identical to SEQ ID NO: 4253457

SEQ ID NO: 4254143 - RNA, 82 nt, Yersinia pestis KIM
gcuccagcgccaauuguugacacuaagcguuucacauuaaaaucugaugugcuguuugguuucaacaaagcaaaccugaagc

SEQ ID NO: 4254144 - RNA, 55 nt, Yersinia pestis KIM
ugaucagcuuaauauuuugcacgcaaccaugcuggcgaugcaaagggcuguaucg

SEQ ID NO: 4254145 - RNA, 56 nt, Yersinia pestis KIM; identical to SEQ ID NO: 4253514

SEQ ID NO: 4254146 - RNA, 94 nt, Yersinia pestis KIM
gauugauccccccucaggcuguguauuccgcacccguugcccaauugccgguacggaaugugcgaaaacacguccuuuauuagaagggaguuuc

SEQ ID NO: 4254147 - RNA, 56 nt, Yersinia pestis KIM; identical to SEQ ID NO: 4253008

SEQ ID NO: 4254148 - RNA, 58 nt, Yersinia pestis KIM
cuggcugauggcccuaaggcagcaaggugaugugcugucuuucgagguuauuagccgg

SEQ ID NO: 4254149 - RNA, 63 nt, Yersinia pestis KIM
uuacuggcugagccacuggucggcaaaucacgaaugugaccgacgcuggacuuaaccacguaa

SEQ ID NO: 4254150 - RNA, 93 nt, Yersinia pestis KIM; identical to SEQ ID NO: 4253361

SEQ ID NO: 4254151 - RNA, 87 nt, Yersinia pestis KIM; identical to SEQ ID NO: 4253403

SEQ ID NO: 4254152 - RNA, 80 nt, Yersinia pestis KIM
gagcugcauagucuauuccuucucaguucaggucaaaccaacuguuuacguugauuagacggagggauggauaacgacuc

SEQ ID NO: 4254153 - RNA, 73 nt, Yersinia pestis KIM
gaguuaggucacauuaucgcuuguuaauaaaugugaguuuaaucgcauuuaguugccgaacgaucccuugcuu

SEQ ID NO: 4254154 - RNA, 82 nt, Yersinia pestis KIM; identical to SEQ ID NO: 4253721

SEQ ID NO: 4254155 - RNA, 63 nt, Yersinia pestis KIM; identical to SEQ ID NO: 4253308

SEQ ID NO: 4254156 - RNA, 58 nt, Yersinia pestis KIM; identical to SEQ ID NO: 4253633

SEQ ID NO: 4254157 - RNA, 99 nt, Yersinia pestis KIM
ggaucuuccaaugcagagguucgcgcggcuaaugagagacuuuaacuuaaugaaaguuaaggauugucauuagucgcgaggaugcagugugaagguauc

SEQ ID NO: 4254158 - RNA, 73 nt, Yersinia pestis KIM
cugccagcaauaagaugggugguuaauauuuccgugcauaucgcgcaucaccgcaucauauuacugacagcag

SEQ ID NO: 4254159 - RNA, 77 nt, Yersinia pestis KIM; identical to SEQ ID NO: 4253541

SEQ ID NO: 4254160 - RNA, 87 nt, Yersinia pestis KIM
uuuuagccaacgcgacccgucuugaaagccuaggugagcacuuuggucacggcuuguaugaggcugaauugcgcuauuugguugaga

SEQ ID NO: 4254161 - RNA, 88 nt, Yersinia pestis KIM; identical to SEQ ID NO: 4253781

SEQ ID NO: 4254162 - RNA, 64 nt, Yersinia pestis KIM; identical to SEQ ID NO: 4253724

SEQ ID NO: 4254163 - RNA, 71 nt, Yersinia pestis KIM
aaugaggagcuuuaaucaugcgcguacuucuuccguuuuuggcgcuguaucgccgucauugguucuugauu

SEQ ID NO: 4254164 - RNA, 66 nt, Yersinia pestis KIM
gcggcaaugugcuguauaccgccgguaacuuuaauaacgauaucggugucccgcuaacauugcugc

SEQ ID NO: 4254165 - RNA, 73 nt, Yersinia pestis KIM; identical to SEQ ID NO: 4253252

SEQ ID NO: 4254166 - RNA, 65 nt, Yersinia pestis KIM; identical to SEQ ID NO: 4253250

SEQ ID NO: 4254167 - RNA, 117 nt, Yersinia pestis KIM
ccgugagauugcguugcuggcagggccuaagcagucgguaucggcaaauuugcggcuuaaaagcuggcuagagacgcuggccgauuaugguuuaucgccugucagugugauccaugg

SEQ ID NO: 4254168 - RNA, 65 nt, Yersinia pestis KIM
aucaucucuuccuaucaaagaggccaguauguugaccacuacgguugucugugggaagaggugau

SEQ ID NO: 4254169 - RNA, 56 nt, Yersinia pestis KIM
acauuguuugcggacagaauuguuucugaaccaagcagguuguugguaaacagggu

SEQ ID NO: 4254170 - RNA, 56 nt, Yersinia pestis KIM; identical to SEQ ID NO: 4253505

SEQ ID NO: 4254171 - RNA, 78 nt, Yersinia pestis KIM
gcugaugaagaacauacuuuuggucaugguaaggcggaguccuuggcggcucuggcccaaaguauguuuauuuccggc

SEQ ID NO: 4254172 - RNA, 67 nt, Yersinia pestis KIM; identical to SEQ ID NO: 4253581

SEQ ID NO: 4254173 - RNA, 90 nt, Yersinia pestis KIM
cuguucauccacuucuuuggcuugcguaugguggcggauauacaccacaucgacguuuuuauagguccggcucaggaagagauagagcag

SEQ ID NO: 4254174 - RNA, 69 nt, Yersinia pestis KIM
aacuuuuguugaagccacccgucuuugccgcaguuaucggcaugaguauguggagcuugaacauugguu

SEQ ID NO: 4254175 - RNA, 80 nt, Yersinia pestis KIM
ccgcggauacguaaaccgauaucauucuggcgcaaccgcuuauccgccgugucaaaauagauauuggccaguguuugugg

SEQ ID NO: 4254176 - RNA, 109 nt, Yersinia pestis KIM
gcggaugcggucugucagaacuuggauauuauccgccgcuaugacgcagaauauaucgucauucuggcuggggaucauaucuauaagauggauuauucucguaugcugc

SEQ ID NO: 4254177 - RNA, 63 nt, Yersinia pestis KIM; identical to SEQ ID NO: 4253170

SEQ ID NO: 4254178 - RNA, 80 nt, Yersinia pestis KIM
agauauuaauuuuauuacuaacaggcuaauaaacaucgcuuuauuuauuaggaugguuagagugggauuaacugaugucu

SEQ ID NO: 4254179 - RNA, 59 nt, Yersinia pestis KIM
gcuaucaaugaugccgcuacugcggcucaacuggcgcaagaggcggggugguugauggc

SEQ ID NO: 4254180 - RNA, 65 nt, Yersinia pestis KIM; identical to SEQ ID NO: 4253068

SEQ ID NO: 4254181 - RNA, 80 nt, Yersinia pestis KIM; identical to SEQ ID NO: 4253246

SEQ ID NO: 4254182 - RNA, 71 nt, Yersinia pestis KIM
guacuaauuccugaaaugauuaaacgccugggauccauaggaucucaggugugagguuauugacaaagugc

SEQ ID NO: 4254183 - RNA, 65 nt, Yersinia pestis KIM
cagcgacggguaacgguggcguaaugcucugaccaaugggauugcagccaguguuuccccgacug

SEQ ID NO: 4254184 - RNA, 63 nt, Yersinia pestis KIM; identical to SEQ ID NO: 4253422

SEQ ID NO: 4254185 - RNA, 120 nt, Yersinia pestis KIM
gcgggguuagggcaugagcgucaaccugucggguccuucuuguuugcuggcccuacggggguagguaaaacagaagugacggugcaguuggccaaagcgcucgauaucgaauugcuccgc

SEQ ID NO: 4254186 - RNA, 98 nt, Yersinia pestis KIM
cugucacucgaucauuaacuuucaugcuauuacccuuaguuaaaucaaugcggcuaguguaguacaaaaugaggggcgaaugauaagguuuacggcag

SEQ ID NO: 4254187 - RNA, 86 nt, Yersinia pestis KIM
gaugauggaacaggucuuaaaaguacccgcuagccgcacccaccaauucgaaguggcgucagugcgcaguaagaccuucaauuauc

SEQ ID NO: 4254188 - RNA, 104 nt, Yersinia pestis KIM; identical to SEQ ID NO: 4253484

SEQ ID NO: 4254189 - RNA, 71 nt, Yersinia pestis KIM; identical to SEQ ID NO: 4253622

SEQ ID NO: 4254190 - RNA, 94 nt, Yersinia pestis KIM
uuaaucaacguuggccacauuuugcucaggccacggcacguagugcggggcuaugugcugagcaggagcaguuauuggaugaacuguuggcuga

SEQ ID NO: 4254191 - RNA, 55 nt, Yersinia pestis KIM
cgcgcaaauuuuuuagcaaguaggaaagugccuuaacuugcugaguauuuucgug

SEQ ID NO: 4254192 - RNA, 73 nt, Yersinia pestis KIM
ccgcggacuuauggcaagagaguggccgcugggagcaguacggcccugaguuguugcguuuuguugaccgcgg

SEQ ID NO: 4254193 - RNA, 64 nt, Yersinia pestis KIM; identical to SEQ ID NO: 4253249

SEQ ID NO: 4254194 - RNA, 77 nt, Yersinia pestis KIM
gaaugcggugccuuaucuggucgcgccacugauugcgaauccgcguacuggcgcggugaccgguaacccacguauuc

SEQ ID NO: 4254195 - RNA, 63 nt, Yersinia pestis KIM
agcggggcuaagguugcaacugccgcuggcgcgguacgcuuaccuuucagcucagaaaacgcu

SEQ ID NO: 4254196 - RNA, 58 nt, Yersinia pestis KIM
aacacaggcguuauguagcgaaaauaccgauuguauucgccugaagaaugcacugguu

SEQ ID NO: 4254197 - RNA, 104 nt, Yersinia pestis KIM; identical to SEQ ID NO: 4253714

SEQ ID NO: 4254198 - RNA, 84 nt, Yersinia pestis KIM
augaaauaggcgauaacgugacguugcuacgugauggagaacagcacuauuucucccugucgcagcucaacguuucgucuucau

SEQ ID NO: 4254199 - RNA, 69 nt, Yersinia pestis KIM
cacuuccaccgccugacugacgaugcuaucaaugucuuuuuguuguaucaggucagcagugaugaagug

SEQ ID NO: 4254200 - RNA, 70 nt, Yersinia pestis KIM
cuuauguugaucauggauaucggcuugaucacaaacaauaauugaugauaucucugcaucaacauagcug

SEQ ID NO: 4254201 - RNA, 79 nt, Yersinia pestis KIM; identical to SEQ ID NO: 4253677

SEQ ID NO: 4254202 - RNA, 79 nt, Yersinia pestis KIM; identical to SEQ ID NO: 4253497

SEQ ID NO: 4254203 - RNA, 74 nt, Yersinia pestis KIM; identical to SEQ ID NO: 4253004

SEQ ID NO: 4254204 - RNA, 64 nt, Yersinia pestis KIM
aucugcugauuauauugguucaguuccugcgauuuuucacugagguaguguuguaacagcgggu

SEQ ID NO: 4254205 - RNA, 85 nt, Yersinia pestis KIM; identical to SEQ ID NO: 4253770

SEQ ID NO: 4254206 - RNA, 74 nt, Yersinia pestis KIM; identical to SEQ ID NO: 4253759

SEQ ID NO: 4254207 - RNA, 65 nt, Yersinia pestis KIM
gaugagugauggcgacaauaaaacgcauugccuccgggucugcuugugcuguugcagucaucauc

SEQ ID NO: 4254208 - RNA, 125 nt, Yersinia pestis KIM
ucaccaaaaauacuguugagcuacuugaaucuauuaugauagucgcaauauucgcuugucgcugacgauuugcaucuacuauuaaugaaucgauucaggcaaccguucucaguaccccaguguga

SEQ ID NO: 4254209 - RNA, 129 nt, Yersinia pestis KIM; identical to SEQ ID NO: 4253549

SEQ ID NO: 4254210 - RNA, 68 nt, Yersinia pestis KIM; identical to SEQ ID NO: 4252996

SEQ ID NO: 4254211 - RNA, 57 nt, Yersinia pestis KIM
uugcuugauuucacauuacgucuuacgccauugccgcguuuuugugugaucaggcaa

SEQ ID NO: 4254212 - RNA, 67 nt, Yersinia pestis KIM
uacagugccugauauucgcguugagguuguauaugccuuaucugaacgccaauacuugcgcacugua

SEQ ID NO: 4254213 - RNA, 61 nt, Yersinia pestis KIM
ccgcugcugggauguuucgaugaucaaccauucgguuauuucgaaguguacugggcggcgg

SEQ ID NO: 4254214 - RNA, 67 nt, Yersinia pestis KIM
cgccaacaguuugaccgcgagucugacaucaccauuaaagcgccgggccgcgucaaucugauuggcg

SEQ ID NO: 4254215 - RNA, 59 nt, Yersinia pestis KIM
gguuugaucgauagccgggcgcuaguugaugugauugaugccguugaauugaucagacc

SEQ ID NO: 4254216 - RNA, 84 nt, Yersinia pestis KIM; identical to SEQ ID NO: 4253700

SEQ ID NO: 4254217 - RNA, 55 nt, Yersinia pestis KIM
gucgcgcuguggcgugaauuuauugccgagcaacauucaugacaccacaacggau

SEQ ID NO: 4254218 - RNA, 100 nt, Yersinia pestis KIM; identical to SEQ ID NO: 4253247

SEQ ID NO: 4254219 - RNA, 61 nt, Yersinia pestis KIM; identical to SEQ ID NO: 4253123

SEQ ID NO: 4254220 - RNA, 73 nt, Yersinia pestis KIM; identical to SEQ ID NO: 4253221

SEQ ID NO: 4254221 - RNA, 70 nt, Yersinia pestis KIM
ggucuuuucacaaugaugacguggcgaagugacgcgaugugaccacugcccaucgucagucaucaagacc

SEQ ID NO: 4254222 - RNA, 61 nt, Yersinia pestis KIM; identical to SEQ ID NO: 4253475

SEQ ID NO: 4254223 - RNA, 92 nt, Yersinia pestis KIM
gguuugaagugcguuggcagcaaaccgcggacccaauauucuuggcaugggccgcgccguugcgccaacguuuuaauuugucuuuuuaagcc

SEQ ID NO: 4254224 - RNA, 79 nt, Yersinia pestis KIM; identical to SEQ ID NO: 4253430

SEQ ID NO: 4254225 - RNA, 72 nt, Yersinia pestis KIM; identical to SEQ ID NO: 4253763

SEQ ID NO: 4254226 - RNA, 85 nt, Yersinia pestis KIM
gaucgcgucaucgggguuugucagcagucugaaaggcccuacggggccuuuuuucguugcugacaauccaauaugauucacuguc

SEQ ID NO: 4254227 - RNA, 86 nt, Yersinia pestis KIM
cagcacaucacgaucccugcucaucaagucaacgcugacuucuucgaagaaggcaaaauguuugauggcuccucgauugguggcug

SEQ ID NO: 4254228 - RNA, 66 nt, Yersinia pestis KIM; identical to SEQ ID NO: 4253197

SEQ ID NO: 4254229 - RNA, 69 nt, Yersinia pestis KIM
gacaucaucuuucccauauuuugcaacguaguaaagauguuagggauaagcggaaagacgaaaaauguc

SEQ ID NO: 4254230 - RNA, 96 nt, Yersinia pestis KIM; identical to SEQ ID NO: 4253654

SEQ ID NO: 4254231 - RNA, 84 nt, Yersinia pestis KIM
acgguaggcaguggcgggguguaucugaugccugaaauugcccaacaauuggcacggguugcugucgauccauugacccgccgu

SEQ ID NO: 4254232 - RNA, 117 nt, Yersinia pestis KIM
gacuugcagugcuacacgcuggcuguuugccaauguugggcuaauuuguuggugagccugaaaccacucaugggcuugagucccgacgggcgcuaaggcuaaugugcgggcuaaguc

SEQ ID NO: 4254233 - RNA, 77 nt, Yersinia pestis KIM
cccgcauguuaauccugcguggucaggucgcgcuagcggcgauccugacuauugccgcagcgauuggcugguuuggg

SEQ ID NO: 4254234 - RNA, 71 nt, Yersinia pestis KIM
ggggcaguugauuaagcagccuuucaaucuggagcuuaaacagagugaagauggcuaugaugcacuggucc

SEQ ID NO: 4254235 - RNA, 56 nt, Yersinia pestis KIM
gccaguguuacccaccaaggaacgaaguggucuucaccauugguaauaaacgcggu

SEQ ID NO: 4254236 - RNA, 75 nt, Yersinia pestis KIM
cgagucaguggauagacauaauggaguaugccaaugcaugagacugaacuuaaucaugauuauccacgggauuug

SEQ ID NO: 4254237 - RNA, 55 nt, Yersinia pestis KIM; identical to SEQ ID NO: 4253193

SEQ ID NO: 4254238 - RNA, 61 nt, Yersinia pestis KIM
cgccagggcuguuuacacgcaagauaaccgcuuuaaucuuuggaucuaaacgggccuggcg

SEQ ID NO: 4254239 - RNA, 62 nt, Yersinia pestis KIM
ggauaggcagaagaauaaagcgccugggacggguuuacagcaucuuuacuugcugccuauuc

SEQ ID NO: 4254240 - RNA, 83 nt, Yersinia pestis KIM; identical to SEQ ID NO: 4253424

SEQ ID NO: 4254241 - RNA, 64 nt, Yersinia pestis KIM
gcgcccuuggcugaaguuaaucucaauggcgaaugccauuggccgaggugauuuuagccaacgc

SEQ ID NO: 4254242 - RNA, 55 nt, Yersinia pestis KIM
ggugcggaguuggucacauugauggggggguuuuauggugauuacuuucgcagcc

SEQ ID NO: 4254243 - RNA, 60 nt, Yersinia pestis KIM
uaucagcccuggaugaagaugauccacuuuuccugugggaucgccauccugguguugaug

SEQ ID NO: 4254244 - RNA, 75 nt, Yersinia pestis KIM; identical to SEQ ID NO: 4253212

SEQ ID NO: 4254245 - RNA, 63 nt, Yersinia pestis KIM
uaaugcggggguagucauacaaaaugagccuguccauaauucuguguaacugccaccguauua

SEQ ID NO: 4254246 - RNA, 72 nt, Yersinia pestis KIM
accgccccguugaauaauggucguuuuaaucgcaacaucaguggauaauacgcauauucggcuggaaguggu

SEQ ID NO: 4254247 - RNA, 64 nt, Yersinia pestis KIM
caucagggcaaauaucagguuuggggugggagacccgcgcuggcaaucguguuugccuguggug

SEQ ID NO: 4254248 - RNA, 58 nt, Yersinia pestis KIM
ggauuggauagaugccggaucggcauacucauuugcucguucugguauuccuucggcc

SEQ ID NO: 4254249 - RNA, 87 nt, Yersinia pestis KIM; identical to SEQ ID NO: 4253532

SEQ ID NO: 4254250 - RNA, 61 nt, Yersinia pestis KIM
cguuggucaguuuuauuuggcccgcucagaacccugaguugcugcaaaaacuggcagagcg

SEQ ID NO: 4254251 - RNA, 129 nt, Yersinia pestis KIM; identical to SEQ ID NO: 4253614

SEQ ID NO: 4254252 - RNA, 58 nt, Yersinia pestis KIM; identical to SEQ ID NO: 4253456

SEQ ID NO: 4254253 - RNA, 78 nt, Yersinia pestis KIM
gcaauggauucagguggauacccaguuucauaaauuaauuuaugaagccagcggcaauccauuuuuaaucucuuuugc

SEQ ID NO: 4254254 - RNA, 99 nt, Yersinia pestis KIM; identical to SEQ ID NO: 4253244

SEQ ID NO: 4254255 - RNA, 57 nt, Yersinia pestis KIM; identical to SEQ ID NO: 4253285

SEQ ID NO: 4254256 - RNA, 69 nt, Yersinia pestis KIM
gucuuuucccauuggcagguauucgcagccgugccauuuggcuggauaccuggcaaauggcggauggac

SEQ ID NO: 4254257 - RNA, 72 nt, Yersinia pestis KIM
cauaaacgcggcauucgcauccuauuugauguggugaugaaucauguggguuaugcaacgcuggcggauaug

SEQ ID NO: 4254258 - RNA, 61 nt, Yersinia pestis KIM
gagggaauugauugaggcuaaucaaaugauaaauugaugauuuuuucagucguauuuucuc

SEQ ID NO: 4254259 - RNA, 57 nt, Yersinia pestis KIM
ccaggguauuggcggucugggcggugauaucggcauccagauuuucagguacgcugg

SEQ ID NO: 4254260 - RNA, 72 nt, Yersinia pestis KIM
gccuuggucuuuaccuucaaugcguugguaucaaugaugcaguucauugccagugaagacacgcuacaaggc

SEQ ID NO: 4254261 - RNA, 74 nt, Yersinia pestis KIM; identical to SEQ ID NO: 4253350

SEQ ID NO: 4254262 - RNA, 74 nt, Yersinia pestis KIM; identical to SEQ ID NO: 4253334

SEQ ID NO: 4254263 - RNA, 79 nt, Yersinia pestis KIM
gccauagugggaaauugcuuucuuuauguugauuaaagggccuuugauguuaaccgauaagcgaguuugccgcuagggc

SEQ ID NO: 4254264 - RNA, 96 nt, Yersinia pestis KIM; identical to SEQ ID NO: 4253506

SEQ ID NO: 4254265 - RNA, 67 nt, Yersinia pestis KIM
ggggcacaagaagcaaucgggaucaugagccgguaaauucucgguugcgggugcuucuuguuggccu

SEQ ID NO: 4254266 - RNA, 128 nt, Yersinia pestis KIM
cgcucgggacugccgguagcgguggcuucggcacguugaccaguggugcgcuggaauccucuaacguggauuugaguaaagaguuggugaacaugauuguggcgcaacguaacuaucaguccaacgcg

SEQ ID NO: 4254267 - RNA, 62 nt, Yersinia pestis KIM
ggguugucagcagucugaaaucuccuccggagaggagauuagagguuauugacaaagagccc

SEQ ID NO: 4254268 - RNA, 58 nt, Yersinia pestis KIM
ggauagaagcugaacgguuacgggcugaauaugccagcaugaccggugcuucauaacc

SEQ ID NO: 4254269 - RNA, 66 nt, Yersinia pestis KIM; identical to SEQ ID NO: 4253729

SEQ ID NO: 4254270 - RNA, 130 nt, Yersinia pestis KIM; identical to SEQ ID NO: 4253399

SEQ ID NO: 4254271 - RNA, 95 nt, Yersinia pestis KIM
gcuauuauugccaucccccagguuaaucacaucguuacuuugcgagcuacugucuagcacuaacgugucauuaccggcaccggugguuaaugugc

SEQ ID NO: 4254272 - RNA, 59 nt, Yersinia pestis KIM
ugguuucacuuuggcgggugcugaucaugccauuauuccugucauguugggugaggcua

SEQ ID NO: 4254273 - RNA, 74 nt, Yersinia pestis KIM; identical to SEQ ID NO: 4253737

SEQ ID NO: 4254274 - RNA, 87 nt, Yersinia pestis KIM; identical to SEQ ID NO: 4253671

SEQ ID NO: 4254275 - RNA, 65 nt, Yersinia pestis KIM; identical to SEQ ID NO: 4253391

SEQ ID NO: 4254276 - RNA, 88 nt, Yersinia pestis KIM; identical to SEQ ID NO: 4253010

SEQ ID NO: 4254277 - RNA, 56 nt, Yersinia pestis KIM
gauacuguaucgguacucaccgguugggcgacaaacggucgucgccgaugcguguu

SEQ ID NO: 4254278 - RNA, 95 nt, Yersinia pestis KIM
auggcaauuacgccccaaacaauuggcuuuaucgguacucaauuuggcccauaaacugucacugagagccaauugauggugaucgcguaacccau

SEQ ID NO: 4254279 - RNA, 69 nt, Yersinia pestis KIM
ucuggcaaugucguuaauucaaaguaaugcgucgcaaauagcgucauugcuuugauacggcuggccaga

SEQ ID NO: 4254280 - RNA, 113 nt, Yersinia pestis KIM; identical to SEQ ID NO: 4253642

SEQ ID NO: 4254281 - RNA, 75 nt, Yersinia pestis KIM
aauauccuuacgcuauuugccgcgcugcuacauaccaaaaccugguuugagcuggcgccgaaagcggucaauauu

SEQ ID NO: 4254282 - RNA, 61 nt, Yersinia pestis KIM; identical to SEQ ID NO: 4253531

SEQ ID NO: 4254283 - RNA, 77 nt, Yersinia pestis KIM
agauaacagcggcuaacguugaauauuucauuuuauacaguuucuuaguuaaauuucggcguuaguaugccauaucu

SEQ ID NO: 4254284 - RNA, 60 nt, Yersinia pestis KIM
cccguacuuggcacaaucugccauagcccugcggcauuggcggaugaugucgcguguggg

SEQ ID NO: 4254285 - RNA, 104 nt, Yersinia pestis KIM; identical to SEQ ID NO: 4253272

SEQ ID NO: 4254286 - RNA, 100 nt, Yersinia pestis KIM; identical to SEQ ID NO: 4253526

SEQ ID NO: 4254287 - RNA, 57 nt, Yersinia pestis KIM; identical to SEQ ID NO: 4253485

SEQ ID NO: 4254288 - RNA, 70 nt, Yersinia pestis KIM; identical to SEQ ID NO: 4253103

SEQ ID NO: 4254289 - RNA, 122 nt, Yersinia pestis KIM; identical to SEQ ID NO: 4253362

SEQ ID NO: 4254290 - RNA, 70 nt, Yersinia pestis KIM
ucgcuuugcucugcgacgggaagcggugcuaucgccauaaaccgcucaauccguugcagggcgcuggcga

SEQ ID NO: 4254291 - RNA, 55 nt, Yersinia pestis KIM; identical to SEQ ID NO: 4253298

SEQ ID NO: 4254292 - RNA, 59 nt, Yersinia pestis KIM
uuuggcaccuuggauuuuggaucaacugucgcguuaacccaaccaaucucgguggcagg

SEQ ID NO: 4254293 - RNA, 58 nt, Yersinia pestis KIM; identical to SEQ ID NO: 4252952

SEQ ID NO: 4254294 - RNA, 69 nt, Yersinia pestis KIM
gucgugaagacaaagccauugugaauaaauccauugaacgaguuggguuaacggcauugcguucacggc

SEQ ID NO: 4254295 - RNA, 57 nt, Yersinia pestis KIM
cgggaaauagugaguucgucgcagauaaccuuucgcggugaucacuuuuauuucucg

SEQ ID NO: 4254296 - RNA, 101 nt, Yersinia pestis KIM
ggguaucacgacuuucuugaccauggucuauaucguauucguaaacccgcagauucucgggguugcggguauggaugugcaggcgguguucgugacaaccu

SEQ ID NO: 4254297 - RNA, 101 nt, Yersinia pestis KIM
gucaccgcagacggucaucuacgccauguuuccgaaacccaggagccagacuuguucugggccgcucguggcgcuggacccuguucguuuuuuguugugac

SEQ ID NO: 4254298 - RNA, 79 nt, Yersinia pestis KIM
cuuucuaucaagccaguuaucgauaaucucuuaagucagauaugaauuacagaugacuacgaugugacuagauagaaag

SEQ ID NO: 4254299 - RNA, 66 nt, Yersinia pestis KIM
gcuauagguguuuaauaaccccaguucucugacuaaaacgaauugcgggaugauaaacaucgacgc

SEQ ID NO: 4254300 - RNA, 78 nt, Yersinia pestis KIM
agcugaacugguuaaacaauacggugcccugaucgccagauucuugcuccagugccugcaucuguuuaccgguaugcu

SEQ ID NO: 4254301 - RNA, 63 nt, Yersinia pestis KIM
cagucacccuuguuaaacgucaguaaaauuuucuauuugcuugcgcgagacgaagggaggcug

SEQ ID NO: 4254302 - RNA, 80 nt, Yersinia pestis KIM
gucugggcgcaaggauguaugcuugaaggcuuaccggaccaauuuuaugaagccuuuauugaaugcauccagugccagac

SEQ ID NO: 4254303 - RNA, 63 nt, Yersinia pestis KIM; identical to SEQ ID NO: 4253493

SEQ ID NO: 4254304 - RNA, 82 nt, Yersinia pestis KIM
cagucuguugacgcucuugaugaccuacuuuguugacgcuuuuaaugacagggccuuaccaucaacgagcaccacacgguug

SEQ ID NO: 4254305 - RNA, 66 nt, Yersinia pestis KIM
uugggcggcgguugucgguauggcgcugauuauuucggguguuauggugauuaaccuccuguccaa

SEQ ID NO: 4254306 - RNA, 76 nt, Yersinia pestis KIM
augauauugaacguuucuacccgcaggggaggccgaaagaugggccuccugcuacgcugaaaugugacuauuucau

SEQ ID NO: 4254307 - RNA, 61 nt, Yersinia pestis KIM
ggcucacaccaaauggcgugcucugcgugagucugaagauucacguuaucuugguuugacc

SEQ ID NO: 4254308 - RNA, 76 nt, Yersinia pestis KIM; identical to SEQ ID NO: 4253304

SEQ ID NO: 4254309 - RNA, 57 nt, Yersinia pestis KIM
gcgcaggaacugauugaccauuugguuaugaaacugcguaugguucguuuccugcgu

SEQ ID NO: 4254310 - RNA, 58 nt, Yersinia pestis KIM; identical to SEQ ID NO: 4253171

SEQ ID NO: 4254311 - RNA, 55 nt, Yersinia pestis KIM; identical to SEQ ID NO: 4253013

SEQ ID NO: 4254312 - RNA, 93 nt, Yersinia pestis KIM
ucagacuucaagugaccuguagguuagcuguucucgugcuauucgaauuauuuugaacauaggguggcggcuaaaaaaggaauuugaauauga

SEQ ID NO: 4254313 - RNA, 61 nt, Yersinia pestis KIM; identical to SEQ ID NO: 4253640

SEQ ID NO: 4254314 - RNA, 77 nt, Yersinia pestis KIM
ucgcgagacauuauucuauuucaaugugcgggaaaucccaccgcaaagcgaaaugaauaaugucguacaaauugcga

SEQ ID NO: 4254315 - RNA, 69 nt, Yersinia pestis KIM
uugaaagugcugcuugagaacuuacuacgccacuuggauggggugcaaguucaggaagcggauuuaaaa

SEQ ID NO: 4254316 - RNA, 87 nt, Yersinia pestis KIM
cugguaacagagccuuauaggcgcauaugaaaaaccuccggcuaugccggaggauauuuauuugugcucuauuuuuuuaguuggcag

SEQ ID NO: 4254317 - RNA, 97 nt, Yersinia pestis KIM
ccggucagcacauggucgaacagugcaauaucguucagguucagcgucgcaucagcgauaucgaccuucaccguauugccuaccccguugcugcugg

SEQ ID NO: 4254318 - RNA, 62 nt, Yersinia pestis KIM
ugaaaauuuuuugucgcaaugccgcucuauuuaaugagccaucuugcugcaaaauauuuuca

SEQ ID NO: 4254319 - RNA, 108 nt, Yersinia pestis KIM
ugccagcaccaaagcuaacccugucuuuuucaucacuccuccacgcauuauuauuccuaucuagugacuggagugaugauugaaacacagguuguaaagugaacagca

SEQ ID NO: 4254320 - RNA, 110 nt, Yersinia pestis KIM
ugguuucacugaguugcagaccauucguuuagagcgcacgggguuuaaagauauuuuuucaccucugauuaucucugaacaagugggugucgcuaagccugauguugcca

SEQ ID NO: 4254321 - RNA, 77 nt, Yersinia pestis KIM
cgguuaccucucccaauaucugaucacgguauucgacgccaaauuugcuuaucaggugauuggggcgguaaugaccg

SEQ ID NO: 4254322 - RNA, 84 nt, Yersinia pestis KIM
caauucccggcaauccgcgaauauccgugguuguggagucugcugucacagccauggcugugcgcaaugauugcucuggcauug

SEQ ID NO: 4254323 - RNA, 66 nt, Yersinia pestis KIM; identical to SEQ ID NO: 4253442

SEQ ID NO: 4254324 - RNA, 65 nt, Yersinia pestis KIM
gauugcaugacugaaaggccgaguuuggacuuuaugguccauggaccgguaucagucaugcuauu

SEQ ID NO: 4254325 - RNA, 78 nt, Yersinia pestis KIM
ccagccgcugguauuagauauugaaagggagaguacccccuugucuuuaaccuugauaccagauacaaaaucgguugg

SEQ ID NO: 4254326 - RNA, 57 nt, Yersinia pestis KIM; identical to SEQ ID NO: 4253664

SEQ ID NO: 4254327 - RNA, 55 nt, Yersinia pestis KIM; identical to SEQ ID NO: 4253161

SEQ ID NO: 4254328 - RNA, 119 nt, Yersinia pestis KIM
uaucuggcgcuuucaaugguggcgcagucauccucuuggugucauugugcuguguaugaacaugguauuacugacucaacggcgugaugaguaucacuggcguguggauaugcuggaua

SEQ ID NO: 4254329 - RNA, 59 nt, Yersinia pestis KIM
acugcgucuaugacaucacuaacugggauugcguucagauagcgaucaguagugucagu

SEQ ID NO: 4254330 - RNA, 61 nt, Yersinia pestis KIM
gcccaaugccgaucaguuaaggaucgguugaacgagauccuuaacugaucggcauugcugc

SEQ ID NO: 4254331 - RNA, 88 nt, Yersinia pestis KIM
acuucauuugguugcaagauggcguguauaacgaugagaccgauggucauaucgauaauaugugcuguuuuguccgcccaggcgaagu

SEQ ID NO: 4254332 - RNA, 64 nt, Yersinia pestis KIM; identical to SEQ ID NO: 4253371

SEQ ID NO: 4254333 - RNA, 72 nt, Yersinia pestis KIM
uagguauucuuaauauuauuauuccgcuaacuuauuucucugcgguuaacuugaugauauuaagaauagcua

SEQ ID NO: 4254334 - RNA, 66 nt, Yersinia pestis KIM
gaaaggcgaaguguuagugcggauugucgccaguggcguuugucacacugacgcuuauacccuuuc

SEQ ID NO: 4254335 - RNA, 71 nt, Yersinia pestis KIM
ggcggcgggcggcgguggaugccaacccgccaccugugucagcgugguaugcgccgccagccagugcugcc

SEQ ID NO: 4254336 - RNA, 90 nt, Yersinia pestis KIM
gauguagggaauuuaaugcagggaauaccguguuuuuacgauuugccuauucucuucguuguguauauuuugucauuaauucccucuauu

SEQ ID NO: 4254337 - RNA, 56 nt, Yersinia pestis KIM; identical to SEQ ID NO: 4253747

SEQ ID NO: 4254338 - RNA, 69 nt, Yersinia pestis KIM; identical to SEQ ID NO: 4253164

SEQ ID NO: 4254339 - RNA, 127 nt, Yersinia pestis KIM
ucauagcaggcucuccuuaucauuauuuggucugugauuuugcuguagaugauugcucuauagaugucugcgcuauagacgguugaucuguagguaauuggcuuggagaugauugguuugaagauga

SEQ ID NO: 4254340 - RNA, 61 nt, Yersinia pestis KIM
uauucugaacuggaagaagaguggaaagcagaaaaagcuucacucaccgggacucagaaua

SEQ ID NO: 4254341 - RNA, 64 nt, Yersinia pestis KIM
guaaagccaagaguaugagcauuaauauuuauuauuacgucucucucaggcgcuuggauuuuac

SEQ ID NO: 4254342 - RNA, 55 nt, Yersinia pestis KIM
gcaaguaaaucuggaaaccaugguguuuaacgccacgauccccgguuuacuuagc

SEQ ID NO: 4254343 - RNA, 63 nt, Yersinia pestis KIM
uuuguaauguagacaaggagaauggcaacggugccguuuccgauucccguuuaucauuauagg

SEQ ID NO: 4254344 - RNA, 115 nt, Yersinia pestis KIM
ucgaaccuaaagugaucccuaugcgcggcgguaccgauggugcggcguuaucaacccaaggguugcugaccccaaauuauuuuaccggggcgcauaauuuccacucaccguucga

SEQ ID NO: 4254345 - RNA, 76 nt, Yersinia pestis KIM
aagcaauccuugaauucagucacuguauaaacagcagauuagcaucaauauagcagcaugaauuuaacaggugcuu

SEQ ID NO: 4254346 - RNA, 113 nt, Yersinia pestis KIM
gacuccgagguugacaguaaauuagauuuuuacaguaaauggauaacaagauguuuacagugaaucacuauagauaguuguaucugauugugaguuugcacacaauaagaguc

SEQ ID NO: 4254347 - RNA, 55 nt, Yersinia pestis KIM; identical to SEQ ID NO: 4253623

SEQ ID NO: 4254348 - RNA, 61 nt, Yersinia pestis KIM
ggcauuggcuauugaugggcaauaugucaaugaggauaacgcuauucauauggccagugcu

SEQ ID NO: 4254349 - RNA, 57 nt, Yersinia pestis KIM
gccaauaaaguccgugaaaucgcugccagacuggggcgucauguagcuauucuuggu

SEQ ID NO: 4254350 - RNA, 83 nt, Yersinia pestis KIM
gaaauuugcuggcuuaauuuggguaagaccugugcugugcucagcgcuaucaggcuaccgaaacuuagcgccagcaucauuuc

SEQ ID NO: 4254351 - RNA, 81 nt, Yersinia pestis KIM
ucguagucuguugcguggucugagcgguugguuguggauuguuauccacuugccaagcuugccagaucaugaaagacacga

SEQ ID NO: 4254352 - RNA, 98 nt, Yersinia pestis KIM
gaaauagccguugugggugauaugaaacuguaaauaagucuguguaaccgcagcccuuauuuauuuuucgcacuucuacuuauuugcucgcuuauuuc

SEQ ID NO: 4254353 - RNA, 80 nt, Yersinia pestis KIM
gcgcagauagucgauaaauugcucaauaaucgcauugcacucuucaaugucuuuauugaucgauucagacagguaagcgu

SEQ ID NO: 4254354 - RNA, 77 nt, Yersinia pestis KIM; identical to SEQ ID NO: 4253575

SEQ ID NO: 4254355 - RNA, 71 nt, Yersinia pestis KIM; identical to SEQ ID NO: 4253708

SEQ ID NO: 4254356 - RNA, 59 nt, Yersinia pestis KIM
agguaagucagagugaucaacuuuaggggccguuuuggccgcccgcucuggcacuaucu

SEQ ID NO: 4254357 - RNA, 92 nt, Yersinia pestis KIM
accauugaugcgguccguaccgcucagaaacguuuagauuacgcagguaucuauucgccugagcagguuacacgaguggccgacucuguggu

SEQ ID NO: 4254358 - RNA, 64 nt, Yersinia pestis KIM
augcugaugaugacguuggccgccguugguuaagccaauugccgcaggcugucgccgucagcau

SEQ ID NO: 4254359 - RNA, 73 nt, Yersinia pestis KIM
gccugaaagcagagaauucaguaauucgcucuguguccgccauugggcauccagaaugcguugcugaucgggc

SEQ ID NO: 4254360 - RNA, 57 nt, Yersinia pestis KIM
gggauagauucaaucaacugaagagugagcaacgcuucaaucguggauucugcuccc

SEQ ID NO: 4254361 - RNA, 59 nt, Yersinia pestis KIM
gccauggcugauuuuucuggagcggguacucauccgcuccggaucgaugggccucuugc

SEQ ID NO: 4254362 - RNA, 70 nt, Yersinia pestis KIM; identical to SEQ ID NO: 4253377

SEQ ID NO: 4254363 - RNA, 66 nt, Yersinia pestis KIM; identical to SEQ ID NO: 4253524

SEQ ID NO: 4254364 - RNA, 83 nt, Yersinia pestis KIM
uaacaaggaauagucgccguaauagauaugcgcccacaacagcccccuaacgacguucuacuggcaggcgagcugccuuguua

SEQ ID NO: 4254365 - RNA, 97 nt, Yersinia pestis KIM; identical to SEQ ID NO: 4253303

SEQ ID NO: 4254366 - RNA, 70 nt, Yersinia pestis KIM
gagggguaccggcaccaaacaguauugcagcagacaaugccgccaauacacccggaugccguaguccauc

SEQ ID NO: 4254367 - RNA, 70 nt, Yersinia pestis KIM
uccgggcaaaugcaugggcugguaucacuugaugcugggcaucagguguugcgcccggcgauccucugga

SEQ ID NO: 4254368 - RNA, 87 nt, Yersinia pestis KIM
auaaagagcccgauuauuuggacaucccggcguuuuugcgcaagcaagccgauuaauuuccgaauauuuggaaucuccgcucuuugu

SEQ ID NO: 4254369 - RNA, 89 nt, Yersinia pestis KIM
uggggaaccugaugcgugguucaaugauggucgaagggcguguagcacgcgucguuuauaucucguuguaucguaugcaucaggucgca

SEQ ID NO: 4254370 - RNA, 64 nt, Yersinia pestis KIM
ugcugaaagcacccgcgguggcauuugaucaucuggaugauaugcaccaggcguuuuuacagca

SEQ ID NO: 4254371 - RNA, 129 nt, Yersinia pestis KIM
auccagacggcaaauaugaacaaaaccuucgucguuuugcagguaaugauuuuguagccagcccgccaugcguugugcgguugccuggucguuacagacggcaaacaacguggggccggauccggaaau

SEQ ID NO: 4254372 - RNA, 67 nt, Yersinia pestis KIM; identical to SEQ ID NO: 4253291

SEQ ID NO: 4254373 - RNA, 59 nt, Yersinia pestis KIM
gucgugguccaaauugucauccuggaugcggucuucucccuggaugcagugauuacggc

SEQ ID NO: 4254374 - RNA, 82 nt, Yersinia pestis KIM
agaggggucauaaugcacugaaccccagaucuuggaucuuuuuauccaugaucuggagguucgguucaaugaaacacccuuu

SEQ ID NO: 4254375 - RNA, 112 nt, Yersinia pestis KIM
cgccguuuuccugaguguccagccgcagggucaguuggugguacaucaccgcgaccugcuuuuugucaucgccgaacugauuguggacaucgcgccaggccugacgauagcg

SEQ ID NO: 4254376 - RNA, 58 nt, Yersinia pestis KIM
gccguguaaaugcacaacaagcccggcguuuuauggaucggguuguuggcuauauggu

SEQ ID NO: 4254377 - RNA, 59 nt, Yersinia pestis KIM
ggcgcacgccaucaggauacauuagguuauccaugaugaucuucaugugcugcucggcc

SEQ ID NO: 4254378 - RNA, 69 nt, Yersinia pestis KIM; identical to SEQ ID NO: 4253660

SEQ ID NO: 4254379 - RNA, 68 nt, Yersinia pestis KIM; identical to SEQ ID NO: 4253674

SEQ ID NO: 4254380 - RNA, 129 nt, Yersinia pestis KIM; identical to SEQ ID NO: 4253127

SEQ ID NO: 4254381 - RNA, 60 nt, Yersinia pestis KIM; identical to SEQ ID NO: 4253698

SEQ ID NO: 4254382 - RNA, 116 nt, Yersinia pestis KIM
gcuuuaacuauuuuauuuaaugcgauuguugacguguuguaugccguuaucgauccaaaaauccguuacuaguacuggagcacgucaauuauguugagcaagaaaaauagcgaagc

SEQ ID NO: 4254383 - RNA, 84 nt, Yersinia pestis KIM; identical to SEQ ID NO: 4227213

SEQ ID NO: 4254384 - RNA, 57 nt, Yersinia pestis KIM
cggcgaucucaugguggugucugcugccgggagcacgacaaaccaguugaucaguug

SEQ ID NO: 4254385 - RNA, 59 nt, Yersinia pestis KIM; identical to SEQ ID NO: 4253021

SEQ ID NO: 4254386 - RNA, 119 nt, Yersinia pestis KIM
gcggcgguuaggugguuccaguguugagcagucugggugauccgcgcaucgccaugauugauaaagucaugguguauguaccggucacuccgcgcuguucgccacggucauaaccccgc

SEQ ID NO: 4254387 - RNA, 88 nt, Yersinia pestis KIM
guggguauugucguugauauugucguugauauugucguugauauugucguugauauugucguugauauugucgcaaggcaguaaacac

SEQ ID NO: 4254388 - RNA, 96 nt, Yersinia pestis KIM
caggccagaaacugccgcgaaagaggcaauugccgccaauggugaaacguucagcgccagcgccauuggcauuaaugccuuggcgguugcagcuug

SEQ ID NO: 4254389 - RNA, 85 nt, Yersinia pestis KIM
aagggcuacgauuaguggcgaugcuggcaaugcugguggucaucauggccgguauuaaagcggcaucaccaauugucguccccuu

SEQ ID NO: 4254390 - RNA, 60 nt, Yersinia pestis KIM; identical to SEQ ID NO: 4253727

SEQ ID NO: 4254391 - RNA, 62 nt, Yersinia pestis KIM
cgucugcugugaguaauacucuugcaauugcuucauuauucgggaguagcuuucucagugcg

SEQ ID NO: 4254392 - RNA, 76 nt, Yersinia pestis KIM
guccucucugcucagcauguugauguccuuucuggugugagaaccucaaggaaacaacauguuggguggagcggac

SEQ ID NO: 4254393 - RNA, 59 nt, Yersinia pestis KIM
uugggguaaugugcagcggugugaagccugcaucagucaccgccuggcuauagcccuga

SEQ ID NO: 4254394 - RNA, 129 nt, Yersinia pestis KIM
uagcuguugcucaugcagauggcggcuuugcaaggcgguuaguucauguucaaacgccuggaucugugucugaacgucaucuagccguugaucaaccgcuucgcccaguugcuucucccguaccagaua

SEQ ID NO: 4254395 - RNA, 95 nt, Yersinia pestis KIM
gccucagucauccguaugucacacaguggguuauugauugccuaaauuauuggcgcgauagcugccauguggacggcuuucguuuugacuuaggc

SEQ ID NO: 4254396 - RNA, 85 nt, Yersinia pestis KIM
gugacugggucggaauguagcugucaauggugguuuugaagacaucuucgcgaauacuauugaugguuucgcugacaucagacac

SEQ ID NO: 4254397 - RNA, 76 nt, Yersinia pestis KIM; identical to SEQ ID NO: 4253119

SEQ ID NO: 4254398 - RNA, 58 nt, Yersinia pestis KIM; identical to SEQ ID NO: 4253529

SEQ ID NO: 4254399 - RNA, 62 nt, Yersinia pestis KIM; identical to SEQ ID NO: 4253302

SEQ ID NO: 4254400 - RNA, 77 nt, Yersinia pestis KIM; identical to SEQ ID NO: 4253073

SEQ ID NO: 4254401 - RNA, 82 nt, Yersinia pestis KIM
cugcuagaggcuugugcugugggguaucagcauuaccucgaacggguggcugcguuagccccugcggcagagguauuggcag

SEQ ID NO: 4254402 - RNA, 81 nt, Yersinia pestis KIM
caguauccgauauucaucuuggauuucagugcuuucuuguucuuuuugcugaaaauauaagcgacaaugucggauuuccug

SEQ ID NO: 4254403 - RNA, 66 nt, Yersinia pestis KIM; identical to SEQ ID NO: 4227284

SEQ ID NO: 4254404 - RNA, 75 nt, Yersinia pestis KIM
gagauugguagcgguuauuuucaggaaacucacccacaggaguuauuccgcgaauguagccacuacugugaacuc

SEQ ID NO: 4254405 - RNA, 93 nt, Yersinia pestis KIM
gcgaugaaccguucauuuaucagugucauugccggugguuucgguacugaugguucuucuaccggcaaugcugaagaaaugggcgaauaucgu

SEQ ID NO: 4254406 - RNA, 60 nt, Yersinia pestis KIM; identical to SEQ ID NO: 4253617

SEQ ID NO: 4254407 - RNA, 64 nt, Yersinia pestis KIM
aucggcaaacugaugguggacucuggcgcugcucaucagauagcccagacgcuauugcgccgau

SEQ ID NO: 4254408 - RNA, 65 nt, Yersinia pestis KIM
gccgcauugcguuuggucgguguaaccggaacgaauggcaaaaccaccacuacgcaauuguuagc

SEQ ID NO: 4254409 - RNA, 84 nt, Yersinia pestis KIM; identical to SEQ ID NO: 4253326

SEQ ID NO: 4254410 - RNA, 78 nt, Yersinia pestis KIM
ggcacaccuuacugagaaucgaugagugcgacaaguauuucuggauacacucgucauauuucacgugggauguacgcc

SEQ ID NO: 4254411 - RNA, 57 nt, Yersinia pestis KIM; identical to SEQ ID NO: 4253012

SEQ ID NO: 4254412 - RNA, 127 nt, Yersinia pestis KIM
ugagucagucaaguagucuggcauuugccauuggagucuucgcuggcagugccuauugcaucguauugguaaugagccuauugcugcccgagaccaaaaauaaacagcuagaauaagugacgauuua

SEQ ID NO: 4254413 - RNA, 76 nt, Yersinia pestis KIM
ggcgcgggccauuugcgguuuagagaaacgugcugaugucauugcguuuuuccugaaccgcggggugggccacacc

SEQ ID NO: 4254414 - RNA, 56 nt, Yersinia pestis KIM
gucaucuucaucgcugauacgaugacauucaucgauaaucagcagagaaaaugcgc

SEQ ID NO: 4254415 - RNA, 91 nt, Yersinia pestis KIM; identical to SEQ ID NO: 4253029

SEQ ID NO: 4254416 - RNA, 70 nt, Yersinia pestis KIM; identical to SEQ ID NO: 4253611

SEQ ID NO: 4254417 - RNA, 68 nt, Yersinia pestis KIM; identical to SEQ ID NO: 4253109

SEQ ID NO: 4254418 - RNA, 57 nt, Yersinia pestis KIM
gauuuagaugcaaucaauagagccgaauuuuugguugcuauugaugucuuugaacuc

SEQ ID NO: 4254419 - RNA, 129 nt, Yersinia pestis KIM
ugcgugcaggcaaagcaaauaucagugacagcuacguaauguuuaaaaacggugaggcauuccuguuuggggccacaauuacgccguugaacguugcgucgacucauguuguuugcgagccuaugcgua

SEQ ID NO: 4254420 - RNA, 73 nt, Yersinia pestis KIM
acucacuauaaguuaauuauuuacucugaugaguauuuuaaguucauuagcagugaugguuauuuauuugagu

SEQ ID NO: 4254421 - RNA, 84 nt, Yersinia pestis KIM
gaguuguuuaauucgggauuugacgaagauuaagggcgcacgcaguguagguaaucguuugcuaagcacgaaaaagacgaucuu

SEQ ID NO: 4254422 - RNA, 57 nt, Yersinia pestis KIM
uuguugcucagaagucgcgaguagagaaauacuuuccgugcgagaaccuggcgacaa

SEQ ID NO: 4254423 - RNA, 64 nt, Yersinia pestis KIM
ucaccccguucaacaucguagccagugaguuggccguuauugagcugcgccugaccggugguga

SEQ ID NO: 4254424 - RNA, 68 nt, Yersinia pestis KIM
auaccggaagagcuaacgacaggccaaucaagauuaauaaugcuaaaucgagcagccucaucuggugu

SEQ ID NO: 4254425 - RNA, 62 nt, Yersinia pestis KIM; identical to SEQ ID NO: 4253478

SEQ ID NO: 4254426 - RNA, 95 nt, Yersinia pestis KIM
cguugagaaguugugguuguuguugcagucuuugguuaaggagagauaaaagggccuuaccauauuaagaauugaacaaugagcaaugagcaaug

SEQ ID NO: 4254427 - RNA, 58 nt, Yersinia pestis KIM
uugaugucggcauguuuguuggugcuuuucuggcgaaagagaucaaugccgauguuga

SEQ ID NO: 4254428 - RNA, 77 nt, Yersinia pestis KIM
guaacgagguccgguucagcgguauugccgggcgaguuauuccugcuggucgccugcugaaccgggccgaugguuac

SEQ ID NO: 4254429 - RNA, 79 nt, Yersinia pestis KIM
aagauacugaggcgcuguugcgccaguuggcuggagcagugagagcucgccgccaguaggcuaacgcgcuugcuauuuu

SEQ ID NO: 4254430 - RNA, 84 nt, Yersinia pestis KIM; identical to SEQ ID NO: 4253154

SEQ ID NO: 4254431 - RNA, 129 nt, Yersinia pestis KIM
cauugugggcgcacugacucuguaucucgauuucauuaaccuguucuugauguuauuacgaaucuucgguaaucgucgcuaagcggguugauuaaacgcuauggcgcgguaaguuugcccaccgacaug

SEQ ID NO: 4254432 - RNA, 71 nt, Yersinia pestis KIM
uugggggcgguaaagcccggcaucaucaaguuaccgguuaucuggcgugaugccgguaccgcuugcuccaa

SEQ ID NO: 4254433 - RNA, 89 nt, Yersinia pestis KIM
caguaaccgguauccguucguggauccugcguaacuugccaauggggguugcgcacgguacgggcaucgguauuggucuguucuugcug

SEQ ID NO: 4254434 - RNA, 59 nt, Yersinia pestis KIM; identical to SEQ ID NO: 4252978

SEQ ID NO: 4254435 - RNA, 112 nt, Yersinia pestis KIM; identical to SEQ ID NO: 4253582

SEQ ID NO: 4254436 - RNA, 116 nt, Yersinia pestis KIM
gccaagccguugaacagauugcugcagcguuggauauugagcacaaauuucccuguaaaaaaugagguuauuaugucagcgauugaacaguuaucuuauuaucaaaaaaaauuggc

SEQ ID NO: 4254437 - RNA, 64 nt, Yersinia pestis KIM; identical to SEQ ID NO: 4253152

SEQ ID NO: 4254438 - RNA, 72 nt, Yersinia pestis KIM
gcgcggcuccagugccuuucgcgcggcguuggaugucgaauucaauguucgucgugagggcgacggcggcgc

SEQ ID NO: 4254439 - RNA, 110 nt, Yersinia pestis KIM; identical to SEQ ID NO: 4253003

SEQ ID NO: 4254440 - RNA, 87 nt, Yersinia pestis KIM; identical to SEQ ID NO: 4253447

SEQ ID NO: 4254441 - RNA, 62 nt, Yersinia pestis KIM
aucagccaaguacagaagaaauugcgcaguuuaaaaccgcaguauuacuguucuugucuggu

SEQ ID NO: 4254442 - RNA, 62 nt, Yersinia pestis KIM
gcagcucuauuccauggguacaccgaauggccaaaaggugacuauucugcuggaagaguugc

SEQ ID NO: 4254443 - RNA, 65 nt, Yersinia pestis KIM
ggagagcggccagcuuuguaaucuggcagacauugaugucgccagcuaucagagcggucaucuuc

SEQ ID NO: 4254444 - RNA, 78 nt, Yersinia pestis KIM
gggugcgagucgagcagcuuuguuuggcgcuguuucgccagaacggcguugaguuacagacugccguugauuuuaccc

SEQ ID NO: 4254445 - RNA, 79 nt, Yersinia pestis KIM; identical to SEQ ID NO: 4253088

SEQ ID NO: 4254446 - RNA, 71 nt, Yersinia pestis KIM
gcuaugcagcaaugccgaucaguuaaggaucucguucaaccgauccuuaacugaucggcauugggccuagc

SEQ ID NO: 4254447 - RNA, 55 nt, Yersinia pestis KIM; identical to SEQ ID NO: 4253405

SEQ ID NO: 4254448 - RNA, 58 nt, Yersinia pestis KIM
cuuggugcuuagcacgcguuauugcgacauaaagcaaacgccgcucuucagcaucagg

SEQ ID NO: 4254449 - RNA, 87 nt, Yersinia pestis KIM
uuaucacggugauaaaccuagcccauugcuggcugaugguguugacccccgaaccgggcagcaaauggaguggauauucccugaugg

SEQ ID NO: 4254450 - RNA, 61 nt, Yersinia pestis KIM; identical to SEQ ID NO: 4253449

SEQ ID NO: 4254451 - RNA, 80 nt, Yersinia pestis KIM
guuuauuacuaucgcuuguggugcuaucucuggcuuccaugcucugguauccaguggcaccacaccgaaacugauugaac

SEQ ID NO: 4254452 - RNA, 55 nt, Yersinia pestis KIM; identical to SEQ ID NO: 4253666

SEQ ID NO: 4254453 - RNA, 57 nt, Yersinia pestis KIM
gccuuucuguggccuuuggugcuuuuugcuaaaaaguaguuaagggcagcgaaaggu

SEQ ID NO: 4254454 - RNA, 76 nt, Yersinia pestis KIM
ggguacucagugcacugaaccccagaucuuggaucuuuuuauccaugaucuggagguucgguucaaugaaacaccc

SEQ ID NO: 4254455 - RNA, 56 nt, Yersinia pestis KIM; identical to SEQ ID NO: 4253777

SEQ ID NO: 4254456 - RNA, 72 nt, Yersinia pestis KIM
cucgcuaucugucagcaagaucguagugcguaugccaaugcggcugaacgucugcugauggcuauuggugag

SEQ ID NO: 4254457 - RNA, 59 nt, Yersinia pestis KIM; identical to SEQ ID NO: 4253701

SEQ ID NO: 4254458 - RNA, 129 nt, Yersinia pestis KIM
ccguuugugaagcaggaguuugguguauugccucgucaauuaccugauuacugggggcuggcggggaucagcagcaguaaaauuccagguguugcaggcguuggugccaaaaccgcuacgcugcuacug

SEQ ID NO: 4254459 - RNA, 80 nt, Yersinia pestis KIM
cuuacuugcuggcuuuuuuauccagauuaucagcaggcaguucacccggcagauagucagguaagcggccagcagggaag

SEQ ID NO: 4254460 - RNA, 58 nt, Yersinia pestis KIM; identical to SEQ ID NO: 4253552

SEQ ID NO: 4254461 - RNA, 56 nt, Yersinia pestis KIM; identical to SEQ ID NO: 4253316

SEQ ID NO: 4254462 - RNA, 118 nt, Yersinia pestis KIM
cuaacgauagguucuucgccgacagugggugcaggcgacggguaucacuguagcgacgaauuaggguauuacggucugcauccaaaaauagcaacugcggggaaaagcuguccggcag

SEQ ID NO: 4254463 - RNA, 66 nt, Yersinia pestis KIM
gccaagcugguuaaugagcgcccgauugccacacugcgcgaucuguuagccauuaaaccgcaaggc

SEQ ID NO: 4254464 - RNA, 78 nt, Yersinia pestis KIM
uggaccuuucacuuccugauacugguacucuuugagcuucauacgcacaaagguuuccaauucgcggaaaauugucca

SEQ ID NO: 4254465 - RNA, 59 nt, Yersinia pestis KIM; identical to SEQ ID NO: 4253055

SEQ ID NO: 4254466 - RNA, 66 nt, Yersinia pestis KIM
gguuaaagugcucuucaauauuaauuuuaauaauuuuuaaaaaaaucguauugagagcgcagaacu

SEQ ID NO: 4254467 - RNA, 60 nt, Yersinia pestis KIM
uugcagcggccucgucgagacgaggccuguaaauagcucaagucacgacagcugcugcaa

SEQ ID NO: 4254468 - RNA, 66 nt, Yersinia pestis KIM; identical to SEQ ID NO: 4253092

SEQ ID NO: 4254469 - RNA, 71 nt, Yersinia pestis KIM
ggcugcgaauacguucgcggaucaccgguuccagacuccggaauuguucugguaagcgaauguacguuucu

SEQ ID NO: 4254470 - RNA, 75 nt, Yersinia pestis KIM
caagauggcacgauccacgccgcggggcuggaugucuuugagcaagagccgcugccuguggauucgccacuccug

SEQ ID NO: 4254471 - RNA, 121 nt, Yersinia pestis KIM
uggcaccaugcgcccacagcagauuggcaaagugucuggcaugaccguuaucuguggcaugugauccgcuuuacguucuggcaggcauuuuuauccgcccugcugucggugauaccugcua

SEQ ID NO: 4254472 - RNA, 61 nt, Yersinia pestis KIM
ccugaccuuaacgcacagugaaugcggguugacugcuuuuucauaggcgguuaagguucgg

SEQ ID NO: 4254473 - RNA, 66 nt, Yersinia pestis KIM
auucgguuaguggugaucagcgggauauucacuuuccccaucaacuugcgggucacccaacugaau

SEQ ID NO: 4254474 - RNA, 60 nt, Yersinia pestis KIM; identical to SEQ ID NO: 4253758

SEQ ID NO: 4254475 - RNA, 57 nt, Yersinia pestis KIM
gcgcgaacugaccuauuaagauugaguaagauaaaucuuauagguagaauucgccgc

SEQ ID NO: 4254476 - RNA, 68 nt, Yersinia pestis KIM
uucuggcggaucauugcuaccgcguggaaggugaaagcuaugaaccgguagguaauaucuauccagaa

SEQ ID NO: 4254477 - RNA, 57 nt, Yersinia pestis KIM; identical to SEQ ID NO: 4253052

SEQ ID NO: 4254478 - RNA, 80 nt, Yersinia pestis KIM; identical to SEQ ID NO: 4253024

SEQ ID NO: 4254479 - RNA, 65 nt, Yersinia pestis KIM
aaauggccaguauuuacuguuccggauaacuauauugcuguguucgaaccacaaucuggcuauuu

SEQ ID NO: 4254480 - RNA, 60 nt, Yersinia pestis KIM
gguagcgggugaauucaaggcuuucuggcgagucaucaggccuaucucgcgucgcguacc

SEQ ID NO: 4254481 - RNA, 99 nt, Yersinia pestis KIM
cgugauaacauucuucgguauucggaguuugcaucgguuugguaagccgggauggcccccuagccgaaacagugcucuacccccgaagaugaguucacg

SEQ ID NO: 4254482 - RNA, 58 nt, Yersinia pestis KIM; identical to SEQ ID NO: 4253044

SEQ ID NO: 4254483 - RNA, 58 nt, Yersinia pestis KIM
gauugaugcacuuaaagcagaguggcgcuuagccgccccugaauuagaagcauuaauu

SEQ ID NO: 4254484 - RNA, 70 nt, Yersinia pestis KIM
guaacuggcaugguuugggaacgucggugauggaaauuagucaccgcaguaaagaauuuaugcagguugc

SEQ ID NO: 4254485 - RNA, 125 nt, Yersinia pestis KIM
gucuuuggcgcgugagguggcuucacguggcauuacugucaacguuguggcaccuggcuuuauugagacggacaugacuaggacguugacggaugaucaacgcgcaggcauuuuagcccaaguac

SEQ ID NO: 4254486 - RNA, 96 nt, Yersinia pestis KIM
gguguaaccugcgucuuuugccaucuuaaucgcagccagaguuucggucagagaaccgaucugguugaauuugaucaagauagaguuagcaacacc

SEQ ID NO: 4254487 - RNA, 129 nt, Yersinia pestis KIM; identical to SEQ ID NO: 4253251

SEQ ID NO: 4254488 - RNA, 63 nt, Yersinia pestis KIM
gccagcguuguucugcccugcguauucucugcauucaggaugaugucgcugaacauacgcugc

SEQ ID NO: 4254489 - RNA, 128 nt, Yersinia pestis KIM
gguguugguccuguggugccauuuguggaaauucuuuagccauauucgucaacguaguaggagcauccacuguuccauuuuuauuacuggcaaugucuaaaccauaaucuuguaacagauuccaaccc

SEQ ID NO: 4254490 - RNA, 68 nt, Yersinia pestis KIM
cgucagacuucaagcgacaugugugguggcccgcaggguguguuacccauaaguugccugaguugaug

SEQ ID NO: 4254491 - RNA, 63 nt, Yersinia pestis KIM; identical to SEQ ID NO: 4253436

SEQ ID NO: 4254492 - RNA, 60 nt, Yersinia pestis KIM
cguugugauccauccgcaggacacacaauucucuagguuguccguugcgcaggauccacg

SEQ ID NO: 4254493 - RNA, 100 nt, Yersinia pestis KIM; identical to SEQ ID NO: 4253277

SEQ ID NO: 4254494 - RNA, 102 nt, Yersinia pestis KIM
gauuaucgugccggucauacagguuggcuguuguaugguagaaaacuggauaaacagcggauuaccgauuuucaacgucagcuuggugcggccauggugauu

SEQ ID NO: 4254495 - RNA, 107 nt, Yersinia pestis KIM
uuauaaggaaugcauauaaugcggaucggucaugguuucgauguucauaaauuuggcgagaauggcagugguccacucauuauugguggcgugcguaucccauauga

SEQ ID NO: 4254496 - RNA, 79 nt, Yersinia pestis KIM
uaaaucuacccuguuacggaugcuggccgguuuugaacagccaacgcaaggccagauaguccuugaugggcaggauuua

SEQ ID NO: 4254497 - RNA, 68 nt, Yersinia pestis KIM; identical to SEQ ID NO: 4253180

SEQ ID NO: 4254498 - RNA, 82 nt, Yersinia pestis KIM; identical to SEQ ID NO: 4253690

SEQ ID NO: 4254499 - RNA, 118 nt, Yersinia pestis KIM
uuagaauuaucuugaaagcuacauuuggugaguuuaauucuuuucuaauugcggcucugacaucacaacugagagcuagcaagaagaauugaucauuauuauguagcgauagucuuaa

SEQ ID NO: 4254500 - RNA, 94 nt, Yersinia pestis KIM
auucaguauauuaaaacagggcauugcuguuuuuuauaaagccaaagccaaucuaccauuacugcucuuggcuaacguugccguguuacugaau

SEQ ID NO: 4254501 - RNA, 61 nt, Yersinia pestis KIM
uucuaguuauugcuaucauaguugcgauggagaauaugucgcagauugcggauaacaggag

SEQ ID NO: 4254502 - RNA, 69 nt, Yersinia pestis KIM
aacgccaaugaugcaagugaucccuggcggcgcuuccgcacguccguuugucacgcaucacaaugcguu

SEQ ID NO: 4254503 - RNA, 56 nt, Yersinia pestis KIM
gaaaccaagcaacagcagacagagcagagccugacuuucuguuguguuggucguuc

SEQ ID NO: 4254504 - RNA, 56 nt, Yersinia pestis KIM
uccuuucccuauuuucacuuauggugaaagcaccagagauuaaaucaggggaucga

SEQ ID NO: 4254505 - RNA, 83 nt, Yersinia pestis KIM
gcuguuguagaagcaguuuccaaugagaaaucccuuccgcgcgagaagauuuuugaggcguuggaaaccgcucuagcgacagc

SEQ ID NO: 4254506 - RNA, 75 nt, Yersinia pestis KIM; identical to SEQ ID NO: 4253355

SEQ ID NO: 4254507 - RNA, 112 nt, Yersinia pestis KIM
aucaaaucuuguaacaucuggcugucuacuugaauggaaaucccggccaaugguauuucagggcuggcaaacguuucacacucaaacggcagcggaacacucaggaugaggu

SEQ ID NO: 4254508 - RNA, 58 nt, Yersinia pestis KIM; identical to SEQ ID NO: 4253683

SEQ ID NO: 4254509 - RNA, 73 nt, Yersinia pestis KIM
ugaucuuuuuuaugcgcagcgguuuuauagggcaauagcccucguauaccauaaugcgcuguaauuaaucucg

SEQ ID NO: 4254510 - RNA, 62 nt, Yersinia pestis KIM
ccgauaagagucugcgagccuuuuggucccgacuuaaucuauuggcuuguuaaaucuaucgg

SEQ ID NO: 4254511 - RNA, 60 nt, Yersinia pestis KIM
gggcuggauuuaaauggcgguacgcugaucuuugacgguucaccgccgcaaucucaggcc

SEQ ID NO: 4254512 - RNA, 75 nt, Yersinia pestis KIM; identical to SEQ ID NO: 4253705

SEQ ID NO: 4254513 - RNA, 63 nt, Yersinia pestis KIM
caggcgauuucgcaaaggcauggggccaguggcguguaauaccccccuuucggugaucgcuug

SEQ ID NO: 4254514 - RNA, 64 nt, Yersinia pestis KIM; identical to SEQ ID NO: 4253425

SEQ ID NO: 4254515 - RNA, 63 nt, Yersinia pestis KIM
gguuacggucauaucgguacucaacuggggauucuggcugaaaguaucgguaugaaagucuuc

SEQ ID NO: 4254516 - RNA, 58 nt, Yersinia pestis KIM
guagggcgcugauagagugagaauaaaaccuaaucucuacauuuagucuacgcucuac

SEQ ID NO: 4254517 - RNA, 75 nt, Yersinia pestis KIM; identical to SEQ ID NO: 4253211

SEQ ID NO: 4254518 - RNA, 89 nt, Yersinia pestis KIM
uuucuaugauaacgguauuaaguuuuucuccauugauggcaccaaauugccugaugauguggaagaggcuauugaagccgaaauggaaa

SEQ ID NO: 4254519 - RNA, 70 nt, Yersinia pestis KIM
gcaucgauuaccgcaugauuaaaucugaaauaaagguaaaaaaucaguuuaacaguccgguauucgaagu

SEQ ID NO: 4254520 - RNA, 109 nt, Yersinia pestis KIM
uugccagcaacuaccguaaugaagaaggcuuauccgaguaucucaagcggcacaauauuguggcgauugccgauaucgauacucguaagcugacucgcuugcugcgcga

SEQ ID NO: 4254521 - RNA, 75 nt, Yersinia pestis KIM
gugguucauuccgugccggugcugaagagcagcaauaauuuguacucuuucaccacggcacugagugaacagcac

SEQ ID NO: 4254522 - RNA, 62 nt, Yersinia pestis KIM; identical to SEQ ID NO: 4253187

SEQ ID NO: 4254523 - RNA, 78 nt, Yersinia pestis KIM; identical to SEQ ID NO: 4252951

SEQ ID NO: 4254524 - RNA, 76 nt, Yersinia pestis KIM
gugaagcauuagauaauggcauacucguuuggcuagggauauuuacgcuagaagaaccgucauuauuacuauuuac

SEQ ID NO: 4254525 - RNA, 103 nt, Yersinia pestis KIM
ggggguuugauagcacaaaagcuggcgcuguaugaugccgccugcgcggggugugucgugcauggcguugcugcagauaagcuggcugaaguucaaggcaccc

SEQ ID NO: 4254526 - RNA, 63 nt, Yersinia pestis KIM
uuaaguuuaucucgcugcuuuaagguuugcuucagcgccuuaagguuuaucgagaugccuuaa

SEQ ID NO: 4254527 - RNA, 114 nt, Yersinia pestis KIM
aaaaauaaauuuauuacuuaauggauaaacgucauuauuauuuaauauuuuuagcuuucguucugcaugauagauucuaauggcugguuuacauaagguuuuaauuauauuuuu

SEQ ID NO: 4254528 - RNA, 77 nt, Yersinia pestis KIM
ggggccauaagugcacugaaccccagaucuuggaucuuuuuauccaugaucuggagguucgguucaaugaaacaccc

SEQ ID NO: 4254529 - RNA, 56 nt, Yersinia pestis KIM; identical to SEQ ID NO: 4253601

SEQ ID NO: 4254530 - RNA, 63 nt, Yersinia pestis KIM
ccguuuccagcggaauuucaagcugugugagcaccacauugcuuuguuugagcugggauaagg

SEQ ID NO: 4254531 - RNA, 58 nt, Yersinia pestis KIM
aaaacagccagccagugagcuuaacgcccaucaguuaagcaacugagcuggcuuuuuu

SEQ ID NO: 4254532 - RNA, 76 nt, Yersinia pestis KIM; identical to SEQ ID NO: 4253631

SEQ ID NO: 4254533 - RNA, 68 nt, Yersinia pestis KIM; identical to SEQ ID NO: 4253492

SEQ ID NO: 4254534 - RNA, 67 nt, Yersinia pestis KIM; identical to SEQ ID NO: 4253048

SEQ ID NO: 4254535 - RNA, 102 nt, Yersinia pestis KIM
gguuauaucaaugauauugcugauugggugauggcacauagcugcgaggcgcuggcgccauugguguacgccacucagccgucggauaucauucgugaaauc

SEQ ID NO: 4254536 - RNA, 62 nt, Yersinia pestis KIM
ucacacccgacaugaccuccagcauauguuccgcauaagguugccagucggucgccauguga

SEQ ID NO: 4254537 - RNA, 59 nt, Yersinia pestis KIM
uauugaugacaaaagggccuggguugauauuggccgauuguguccugaaguuaucaaug

SEQ ID NO: 4254538 - RNA, 67 nt, Yersinia pestis KIM; identical to SEQ ID NO: 4253320

SEQ ID NO: 4254539 - RNA, 92 nt, Yersinia pestis KIM; identical to SEQ ID NO: 4253527

SEQ ID NO: 4254540 - RNA, 65 nt, Yersinia pestis KIM
aguggauucgucaucaugaagauggcagugaucacgguuagccauaccaugacugacacgacauu

SEQ ID NO: 4254541 - RNA, 100 nt, Yersinia pestis KIM
ucgcgucaucgggguuugucagccguccgaagggcgcuuuguguauaaaccggucauacauuggcuccccuuuggguuguuucaagauagcugucagcga

SEQ ID NO: 4254542 - RNA, 59 nt, Yersinia pestis KIM; identical to SEQ ID NO: 4253107

SEQ ID NO: 4254543 - RNA, 103 nt, Yersinia pestis KIM
gguucugaguuucagcauacauuacagccagguauacguuguuugcgucguauuuagcgccaacguuccaugccugagcuuugucgccuucagcgguagaacc

SEQ ID NO: 4254544 - RNA, 59 nt, Yersinia pestis KIM
uaaugaaugccuguugcggcgcgcuauuggcgcugauggccguucaagaggcuuuauua

SEQ ID NO: 4254545 - RNA, 95 nt, Yersinia pestis KIM
cgaccaccagcagcccacucaagaaucugguacuggauguagauuauaaugauucagucguugucauuaauaccaguccaggugccgcucaguug

SEQ ID NO: 4254546 - RNA, 67 nt, Yersinia pestis KIM
auacccgugauacuucaaguugcaagcgcguugacugccuuccuauaacucgaauuauuuaggguau

SEQ ID NO: 4254547 - RNA, 90 nt, Yersinia pestis KIM; identical to SEQ ID NO: 4253760

SEQ ID NO: 4254548 - RNA, 68 nt, Yersinia pestis KIM; identical to SEQ ID NO: 4253132

SEQ ID NO: 4254549 - RNA, 128 nt, Yersinia pestis KIM
gcguaauuuguacgauccagaacgccuaaauagucguggguucacuuauuauggaauugggcgugguguuucgauuaaucuaucauaguaagugagaaugcugauuuuauguguugauuacaaaacgu

SEQ ID NO: 4254550 - RNA, 60 nt, Yersinia pestis KIM
guuguuauugcugccguuauuguugccacugaagaaguaguacaggacagcaacagcagc

SEQ ID NO: 4254551 - RNA, 78 nt, Yersinia pestis KIM
gaaacuuacaugcacaacgaaccggaaaugcuugucgaucaggacaagauuacugacgaucuugcugaugcagguuuc

SEQ ID NO: 4254552 - RNA, 78 nt, Yersinia pestis KIM
uggccuugauggugcucuuuagcguuuugcucuauauccauggugagcaagucgccuuagguauccgucauuuugcca

SEQ ID NO: 4254553 - RNA, 95 nt, Yersinia pestis KIM
cggcgcgguuuacaccuuuaacggcaagcgggguaucugggguuggcuacauauugauccugccacgcugcgcugugagggugugccgcucgccg

SEQ ID NO: 4254554 - RNA, 76 nt, Yersinia pestis KIM
gcaacuuaccgguugaaaaaaggacuugugauaauccaccgucacagaaucagccauuucaauaccggaaaguagc

SEQ ID NO: 4254555 - RNA, 56 nt, Yersinia pestis KIM; identical to SEQ ID NO: 4253472

SEQ ID NO: 4254556 - RNA, 63 nt, Yersinia pestis KIM; identical to SEQ ID NO: 4253149

SEQ ID NO: 4254557 - RNA, 94 nt, Yersinia pestis KIM
ggggagcuagacauuauauuaaaugcuacagaaguucuacuugcagaaacaggugcacuucuguagcauuuuccuuuauuauuuuugguuuuuc

SEQ ID NO: 4254558 - RNA, 109 nt, Yersinia pestis KIM
cagccaccuaauuuaucgagcagcaccgcuaauaucuuggcuucacuggucuuuaucacaacccuguuaggccggccaauuggcgcuuuacuguuugggauuauggcug

SEQ ID NO: 4254559 - RNA, 68 nt, Yersinia pestis KIM
gguaaagccauucgugaaauuauggcgcuagcugauguggcuaaucgcuauguugaugaacaggcucc

SEQ ID NO: 4254560 - RNA, 68 nt, Yersinia pestis KIM; identical to SEQ ID NO: 4253772

SEQ ID NO: 4254561 - RNA, 76 nt, Yersinia pestis KIM
caccgauuuaagccguccagaaagcgcuuuggugaauaauuuagccgccgcucaucuggagggguuugguucgcug

SEQ ID NO: 4254562 - RNA, 65 nt, Yersinia pestis KIM
gagagcguugcgcuguccguuauucacaagcggagcaaguaaauggcagauaucgcaacaaucuc

SEQ ID NO: 4254563 - RNA, 90 nt, Yersinia pestis KIM
cuuagcagaauuaucguauuauuuaaaaugauaggguuucuaaauuaauggagccaaaucauugugacuaguuugccaauaacugcuaag

SEQ ID NO: 4254564 - RNA, 118 nt, Yersinia pestis KIM; identical to SEQ ID NO: 4253198

SEQ ID NO: 4254565 - RNA, 77 nt, Yersinia pestis KIM
guuagugauccugaauaugcagcuugaacuggccaaacagcaugauuugccgguuauuuugcauucacgucgcucac

SEQ ID NO: 4254566 - RNA, 124 nt, Yersinia pestis KIM
ggucacauucuugggagaaaagaaugauuucauggaaguuauggggaauguuuuagaaaaugccugcaaauauugccuugaguuuguugaagucaccaccuuacacuccgaaaaacaauugacc

SEQ ID NO: 4254567 - RNA, 77 nt, Yersinia pestis KIM
aauugaaagcagugagcgcagauaacgauuuacagcguuauguaaggucgaaguaauggccucacugaccuuggguu

SEQ ID NO: 4254568 - RNA, 63 nt, Yersinia pestis KIM; identical to SEQ ID NO: 4253299

SEQ ID NO: 4254569 - RNA, 123 nt, Yersinia pestis KIM; identical to SEQ ID NO: 4253767

SEQ ID NO: 4254570 - RNA, 60 nt, Yersinia pestis KIM
agagggaauagguaauacuuccccguuggcauuuucaaaccaauaccauauauucccucu

SEQ ID NO: 4254571 - RNA, 57 nt, Yersinia pestis KIM; identical to SEQ ID NO: 4253124

SEQ ID NO: 4254572 - RNA, 62 nt, Yersinia pestis KIM
uucaggcugcgguucauggucaagggauugcucuggugaauaaugucauggcccagucugag

SEQ ID NO: 4254573 - RNA, 87 nt, Yersinia pestis KIM
gaugguuggccaaucgcuggcugagcagggcauguuggaagaaauuauuccgccuuacuacucagucaaagaagugguacugccguu

SEQ ID NO: 4254574 - RNA, 56 nt, Yersinia pestis KIM
gcuaccggcgaucagcuuuuucgugccaucgggccggauaaucugugcgccggugc

SEQ ID NO: 4254575 - RNA, 92 nt, Yersinia pestis KIM
guccgaugaagcgcgcaaguauuaucugauggaguaugccaaccaaugggaugcauucuucaaugauaucagggugcgcccaaucaacggac

SEQ ID NO: 4254576 - RNA, 75 nt, Yersinia pestis KIM; identical to SEQ ID NO: 4253417

SEQ ID NO: 4254577 - RNA, 72 nt, Yersinia pestis KIM
gccggugucguaacgguggggcuauuugcgaaucgcggugcugauguggcccugauugguacggccaauggc

SEQ ID NO: 4254578 - RNA, 63 nt, Yersinia pestis KIM; identical to SEQ ID NO: 4253110

SEQ ID NO: 4254579 - RNA, 127 nt, Yersinia pestis KIM
uuugaccaauugaugaaaaaagagcaaugaauaauaggcuaacguuguauuuauagauauuuaauuauaaauaacaucacguuacgcuuaucugguugaauugugcgcuuuaguauuuucugucaaa

SEQ ID NO: 4254580 - RNA, 60 nt, Yersinia pestis KIM; identical to SEQ ID NO: 4253576

SEQ ID NO: 4254581 - RNA, 60 nt, Yersinia pestis KIM
cugaacccguugaaguugggcaaaucaccuuggugaauuuuauuaauccagccgguuugg

SEQ ID NO: 4254582 - RNA, 82 nt, Yersinia pestis KIM
uauuucugcuuuacguuuaucugcugauuaccaacguuggaugaguaacggugacuuaacagaaaaacaagaggaagaaaua

SEQ ID NO: 4254583 - RNA, 64 nt, Yersinia pestis KIM; identical to SEQ ID NO: 4253141

SEQ ID NO: 4254584 - RNA, 73 nt, Yersinia pestis KIM
ccacugucacgguugaaauaccgcugugcagcaaguuguuacgcuccgucaggguaaagcgacuggauagcgg

SEQ ID NO: 4254585 - RNA, 57 nt, Yersinia pestis KIM
guuaaagauuauugcacccgagugauaggcauugcucacgggcgaauuaucuuugau

SEQ ID NO: 4254586 - RNA, 128 nt, Yersinia pestis KIM
ggcaaacucucgucuuauaaguucuacgaagcgguaaugagcucccaugcucgucugaccuacacuaagguguggcggauuauagauggugaggaaucgcugcgugagcaauauaagccgcuggugcc

SEQ ID NO: 4254587 - RNA, 86 nt, Yersinia pestis KIM; identical to SEQ ID NO: 4253145

SEQ ID NO: 4254588 - RNA, 76 nt, Yersinia pestis KIM
gaugaggcguucaagaauuugguggcguaaugucgaaucauccggaaccugcugcccagauuguugugcguucauu

SEQ ID NO: 4254589 - RNA, 57 nt, Yersinia pestis KIM
aagcccucgaaauugaacugaucccaaaaaguugggcaguuuacauuacgagggcuu

SEQ ID NO: 4254590 - RNA, 56 nt, Yersinia pestis KIM; identical to SEQ ID NO: 4253646

SEQ ID NO: 4254591 - RNA, 69 nt, Yersinia pestis KIM; identical to SEQ ID NO: 4253039

SEQ ID NO: 4254592 - RNA, 57 nt, Yersinia pestis KIM
cugcgggaauggcaagugcuuaccaugcuccguuggcuggcagccuguuuauugcag

SEQ ID NO: 4254593 - RNA, 60 nt, Yersinia pestis KIM
uggcgaagagcaucgguuccugugguaccagauaaauaccuaauugaugugcuuucgccg

SEQ ID NO: 4254594 - RNA, 59 nt, Yersinia pestis KIM
uggcaucauagagccuggagauauagauccugcgcucucauuaaucggcucuggugcca

SEQ ID NO: 4254595 - RNA, 67 nt, Yersinia pestis KIM
ggccugauccugucaauauugggauauaugccuaauguggcccaaucgacauggacauugaauggcc

SEQ ID NO: 4254596 - RNA, 63 nt, Yersinia pestis KIM
ccgccgggaugagaaaccgaugcucacccgcuccgcauggcaggagguucucguucaggccgg

SEQ ID NO: 4254597 - RNA, 108 nt, Yersinia pestis KIM
accagcggcuucauacgguuggaaugcccauggcccguuaauuaccgcagccgcuuuuuucucagugaauaaugagucaauagcauucaagccguuaucaccgauggu

SEQ ID NO: 4254598 - RNA, 81 nt, Yersinia pestis KIM
gaguuauggagguaaauagcaucguauucacuggcgauauuauugacgucaauguugaccaggugcugccaucaguggcuu

SEQ ID NO: 4254599 - RNA, 85 nt, Yersinia pestis KIM
gaugagagauacaauauuacguuuauugccggcgaauagagguucuauugcuguugaauuuacguuaauuuuuauccuuuuuauc

SEQ ID NO: 4254600 - RNA, 90 nt, Yersinia pestis KIM
ggugucggugauuuaaccagugguuuauugcuggugaauuuguugaaaggugagccauuggauaaagcacuggaacaugucaccgccgcc

SEQ ID NO: 4254601 - RNA, 63 nt, Yersinia pestis KIM
guauggugauagcgcgggcuguagcagugccuaucauagccgugaaucgugcugucaccgugc

SEQ ID NO: 4254602 - RNA, 70 nt, Yersinia pestis KIM
gcaguuccaucaucacgccacuccucugcagaaugagucguagauggagaguggaugaugcagggggugu

SEQ ID NO: 4254603 - RNA, 57 nt, Yersinia pestis KIM; identical to SEQ ID NO: 4253578

SEQ ID NO: 4254604 - RNA, 90 nt, Yersinia pestis KIM
aaucaguuuuucgaaaaucgcguguuuuuguuggucgaaacgugccacguugacggauuggccgaagaacauggguucgagcaacugauu

SEQ ID NO: 4254605 - RNA, 74 nt, Yersinia pestis KIM
gucguuggugccugcuggcgcagagagugggucgguugaucaauucuuugaaaacggcgaggcauuaaaucagc

SEQ ID NO: 4254606 - RNA, 89 nt, Yersinia pestis KIM; identical to SEQ ID NO: 4253281

SEQ ID NO: 4254607 - RNA, 67 nt, Yersinia pestis KIM
gcuggaacauacuuuuagcgauagaaucgucacauugcauuucuaucgaguagaggugugggauggu

SEQ ID NO: 4254608 - RNA, 77 nt, Yersinia pestis KIM
gauggcugguagccauguauuuauaggcagaaucgaaaggaauuuugccguguuggguaacgugguccagcuugauc

SEQ ID NO: 4254609 - RNA, 55 nt, Yersinia pestis KIM; identical to SEQ ID NO: 4253196

SEQ ID NO: 4254610 - RNA, 128 nt, Yersinia pestis KIM
agcguaacaauccaauccguguucugcgugacaacgugguuaucuaugaaggcgagcuggaaucccuacgccgcuucaaagaugacguuagcgaaguucgcaacggcauggagugugguaucggcguu

SEQ ID NO: 4254611 - RNA, 59 nt, Yersinia pestis KIM
guggugagcguccugcucgucgugaacgucgugauguuggcgagauggagcuguaccgc

SEQ ID NO: 4254612 - RNA, 85 nt, Yersinia pestis KIM
aacguugcacggcuuuauaggugguguuaccgguguucaggucugggaagaugaacacggucgcucuaccugcuaccggugaguu

SEQ ID NO: 4254613 - RNA, 57 nt, Yersinia pestis KIM
gcugucuguugccugacgcagacugucauccggauucgucacgcuaaacagauaagc

SEQ ID NO: 4254614 - RNA, 56 nt, Yersinia pestis KIM
gucagugcaucagaggaacaguaucacgaugauuauugugcuuucugaugccugau

SEQ ID NO: 4254615 - RNA, 60 nt, Yersinia pestis KIM; identical to SEQ ID NO: 4253274

SEQ ID NO: 4254616 - RNA, 55 nt, Yersinia pestis KIM
aaccagcguuccagucuuuggugucgaugccuuaccagaagcguuagcgcugguu

SEQ ID NO: 4254617 - RNA, 69 nt, Yersinia pestis KIM; identical to SEQ ID NO: 4253659

SEQ ID NO: 4254618 - RNA, 61 nt, Yersinia pestis KIM
guuggugauuuugucgguacaggcguuggccauggcacuguacgcgauauuugucaccuac

SEQ ID NO: 4254619 - RNA, 108 nt, Yersinia pestis KIM; identical to SEQ ID NO: 4253385

SEQ ID NO: 4254620 - RNA, 61 nt, Yersinia pestis KIM; identical to SEQ ID NO: 4253380

SEQ ID NO: 4254621 - RNA, 70 nt, Yersinia pestis KIM
cuacgcggguaacuuccuacacaugauguucucuacgccaugugagaaauaugaaguuaacccaguacug

SEQ ID NO: 4254622 - RNA, 62 nt, Yersinia pestis KIM
gaugcgcugggaccaacuauuuuugcuacacaaucaacgcauaaauuauuggcagcgcuguc

SEQ ID NO: 4254623 - RNA, 60 nt, Yersinia pestis KIM; identical to SEQ ID NO: 4253310

SEQ ID NO: 4254624 - RNA, 99 nt, Yersinia pestis KIM
gguauaaagcgcgccggcgaaccgcacuauauuccgaugaauaugaaucuuccgaugacguauucugacgauaaguagccaguuuagccgggcaauacc

SEQ ID NO: 4254625 - RNA, 77 nt, Yersinia pestis KIM
cuuuugcucacuguuaggcauuauuaaaaauagagcagagucucugauuuuacugaugucuauuggucgaugcugag

SEQ ID NO: 4254626 - RNA, 57 nt, Yersinia pestis KIM; identical to SEQ ID NO: 4253289

SEQ ID NO: 4254627 - RNA, 65 nt, Yersinia pestis KIM; identical to SEQ ID NO: 4253128

SEQ ID NO: 4254628 - RNA, 80 nt, Yersinia pestis KIM; identical to SEQ ID NO: 4253713

SEQ ID NO: 4254629 - RNA, 64 nt, Yersinia pestis KIM
aaucacuuuggcuuccaguuuuucugcgguuucaacagcaccacggcaaacggcuucagugauu

SEQ ID NO: 4254630 - RNA, 98 nt, Yersinia pestis KIM
auccguugcgggagaaaucggugcugacaccacaggauuuuaacggggaaaauuuugucagccugucagucaccgacaguuaccgucagcuauuggau

SEQ ID NO: 4254631 - RNA, 60 nt, Yersinia pestis KIM
cuggaagauccgcuggggauggaaguggguuaccgcuugauaccgaugguggauuuccag

SEQ ID NO: 4254632 - RNA, 61 nt, Yersinia pestis KIM; identical to SEQ ID NO: 4253158

SEQ ID NO: 4254633 - RNA, 63 nt, Yersinia pestis KIM
aaggccgcgcuugagcguggaugaaucauucuucaugguacauucucgcaaaguuugugccuu

SEQ ID NO: 4254634 - RNA, 59 nt, Yersinia pestis KIM; identical to SEQ ID NO: 4253591

SEQ ID NO: 4254635 - RNA, 82 nt, Yersinia pestis KIM
ugccauuaucuugcugcgugugccggcccuccgcauugucagccaccgugcugaaccggucaccgcaggcaucauaacggua

SEQ ID NO: 4254636 - RNA, 68 nt, Yersinia pestis KIM
ggacuaguuaaagugguagcagagaaagcggaauuuccgugcuaccuauuuuggcuuaaagaaggucc

SEQ ID NO: 4254637 - RNA, 82 nt, Yersinia pestis KIM; identical to SEQ ID NO: 4253016

SEQ ID NO: 4254638 - RNA, 60 nt, Yersinia pestis KIM; identical to SEQ ID NO: 4253651

SEQ ID NO: 4254639 - RNA, 77 nt, Yersinia pestis KIM; identical to SEQ ID NO: 4253437

SEQ ID NO: 4254640 - RNA, 130 nt, Yersinia pestis KIM
gugcacuuugcugcucaauauugaucagaaaacguugugcggucucuggcgguggagacucucgcaguaacucagccgccccggagauagcggccagcgggcuuuucaauucaugagucagcgugugaac

SEQ ID NO: 4254641 - RNA, 62 nt, Yersinia pestis KIM; identical to SEQ ID NO: 4253530

SEQ ID NO: 4254642 - RNA, 93 nt, Yersinia pestis KIM
gcucuaccaugaucgcgaagaaguuacggugcauguccgucguaucuggucgggugcaccgggccgccgugaugagcguuauuagguuuuagc

SEQ ID NO: 4254643 - RNA, 63 nt, Yersinia pestis KIM
gguauuugauagcucuguugagcguggucagccagccgacuuccccgucagcggcguuauccc

SEQ ID NO: 4254644 - RNA, 56 nt, Yersinia pestis KIM
ucuuccggugcaaauacuggcagugccagaucggcugccacucuagcgaccgaaga

SEQ ID NO: 4254645 - RNA, 96 nt, Yersinia pestis KIM
gcugagaaauaagugcauugcaguucguuacgugaaucaguuaaaugggugugcugcaaccaaguccguagcgaaguaaugucacaauuuaacagu

SEQ ID NO: 4254646 - RNA, 55 nt, Yersinia pestis KIM; identical to SEQ ID NO: 4253658

SEQ ID NO: 4254647 - RNA, 119 nt, Yersinia pestis KIM
gcugaagggugggccgguuucugagcgagugcaggacuucaguuaucgcaucggcucgauuuugcuggugcuauuaauggggcuugcacuuuucaaugauuucucccgucuuuaacggc

SEQ ID NO: 4254648 - RNA, 64 nt, Yersinia pestis KIM
guucccagcucaccgugacggguagucugaaguuugauauuucugucacaccggaguuggcagc

SEQ ID NO: 4254649 - RNA, 94 nt, Yersinia pestis KIM
gaaguguauagagaggauuaaagcgguaaucaguagucauugucaaaauucaccgcaaagauuauugguuaguugcgaccuugagguacacuuu

SEQ ID NO: 4254650 - RNA, 63 nt, Yersinia pestis KIM
ucgcuaaccucagauaggagacagggggauaaaaaccccugucuuauuuuuuguagguuauga

SEQ ID NO: 4254651 - RNA, 74 nt, Yersinia pestis KIM
uacgauucaguucauucaguguuuuuugcagaucuuuugguagcuccugcaucgacugacuggacgugauugua

SEQ ID NO: 4254652 - RNA, 126 nt, Yersinia pestis KIM; identical to SEQ ID NO: 4253477

SEQ ID NO: 4254653 - RNA, 55 nt, Yersinia pestis KIM
guugcggugauccacgcggcagguggccuacacaaagccgucgaaacgcugcaac

SEQ ID NO: 4254654 - RNA, 88 nt, Yersinia pestis KIM; identical to SEQ ID NO: 4253722

SEQ ID NO: 4254655 - RNA, 71 nt, Yersinia pestis KIM
gcgggguuuacugauuggcaugggaaugacagagaaacagggcgguuccgaugucuuaaguaacaccacgc

SEQ ID NO: 4254656 - RNA, 68 nt, Yersinia pestis KIM
ucgaguggguugacauuguugaugagcaaaauaacgucauugcucaguccagucgucagcaaaugaga

SEQ ID NO: 4254657 - RNA, 62 nt, Yersinia pestis KIM
gugcugccagauacauacccucuuggcuacccaaagcgagauagaguauggcugguuggcac

SEQ ID NO: 4254658 - RNA, 57 nt, Yersinia pestis KIM; identical to SEQ ID NO: 4253483

SEQ ID NO: 4254659 - RNA, 77 nt, Yersinia pestis KIM
ugguacccgugcggaacaggugaugcagguggaaaaagagcuguucgcgcuguacgccgauccgcauuuggauacca

SEQ ID NO: 4254660 - RNA, 76 nt, Yersinia pestis KIM
gugcgcugguggcguucaccuucguuaacuugucugugauugcucaguucuauguucgugaacgccgcaacaguac

SEQ ID NO: 4254661 - RNA, 68 nt, Yersinia pestis KIM
agagcaccaaagauguuaccgccagcauggaaaacauuacccgcucauuggucucguuuuuggucuuu

SEQ ID NO: 4254662 - RNA, 60 nt, Yersinia pestis KIM
gcaccuucagucuccaaugugaauaauugauucuguucaugcugcaacacugacaggugc

SEQ ID NO: 4254663 - RNA, 64 nt, Yersinia pestis KIM
uugccucucagcagcaaaugagagaaguugucauggcaaaccuuccugcgcugcugaaagguaa

SEQ ID NO: 4254664 - RNA, 124 nt, Yersinia pestis KIM
ggucaaacgagugguguguagcgcgcgugaggaugccguagauuuuuuugccaaacuggguuuuguuugucagggagagauaacggcaccgcaaacgacaccuguacgccauuucuuaaugauc

SEQ ID NO: 4254665 - RNA, 64 nt, Yersinia pestis KIM; identical to SEQ ID NO: 4253452

SEQ ID NO: 4254666 - RNA, 55 nt, Yersinia pestis KIM
uaggugcgguuuucgguggcuauacgcucgucgguggccauuugggugcacucua

SEQ ID NO: 4254667 - RNA, 70 nt, Yersinia pestis KIM
cagaaaguuguucaaccaucauguccgccagcccuaauccuuuggccgacauuugcugcgcaauuugcug

SEQ ID NO: 4254668 - RNA, 55 nt, Yersinia pestis KIM
aaguaaugcgggugugagugcugguauauccaugcgcuaucaccaagcauuauuu

SEQ ID NO: 4254669 - RNA, 77 nt, Yersinia pestis KIM
gcagcacgaguaaugcuucaugaaguugcggauuauuuuuaacgauuucuucugcaagguaagcauucucaaccugc

SEQ ID NO: 4254670 - RNA, 87 nt, Yersinia pestis KIM
agugaagccgccgaggccggugucgagaucauuggcgauaucgaacuguucugccgugaaaaucaggcaccgguuguggcuaucacu

SEQ ID NO: 4254671 - DNA, 12 bp, Homo sapiens
aattgcttgaac

SEQ ID NO: 4254672 - DNA, 10 bp, Homo sapiens
actgcactcc

SEQ ID NO: 4254673 - DNA, 10 bp, Homo sapiens
cactgcactc

SEQ ID NO: 4254674 - DNA, 11 bp, Homo sapiens
ctagactgaag

SEQ ID NO: 4254675 - DNA, 11 bp, Homo sapiens
gaagtttgaag

SEQ ID NO: 4254676 - DNA, 10 bp, Homo sapiens
tcactgcaac

SEQ ID NO: 4254677 - DNA, 12 bp, Homo sapiens
tctaagagaaag

SEQ ID NO: 4254678 - DNA, 10 bp, Homo sapiens
gggcagtgga

SEQ ID NO: 4254679 - DNA, 12 bp, Homo sapiens
aattgcttgaac

SEQ ID NO: 4254680 - DNA, 9 bp, Homo sapiens
agcagccca

SEQ ID NO: 4254681 - DNA, 10 bp, Homo sapiens
aggcaagacg

SEQ ID NO: 4254682 - DNA, 11 bp, Homo sapiens
agggaaagaat

SEQ ID NO: 4254683 - DNA, 11 bp, Homo sapiens
agggaaagaat

SEQ ID NO: 4254684 - DNA, 9 bp, Homo sapiens
attcagttg

SEQ ID NO: 4254685 - DNA, 11 bp, Homo sapiens
ctagactgaag

SEQ ID NO: 4254686 - DNA, 11 bp, Homo sapiens
ttcagagtggt

SEQ ID NO: 4254687 - DNA, 11 bp, Homo sapiens
ttcagagtggt

SEQ ID NO: 4254688 - DNA, 9 bp, Homo sapiens
agcagccca

SEQ ID NO: 4254689 - DNA, 11 bp, Homo sapiens
agtttgccttg

SEQ ID NO: 4254690 - DNA, 11 bp, Homo sapiens
atcagagggtg

SEQ ID NO: 4254691 - DNA, 10 bp, Homo sapiens
atggtgggag

SEQ ID NO: 4254692 - DNA, 9 bp, Homo sapiens
cccaggaag

SEQ ID NO: 4254693 - DNA, 10 bp, Homo sapiens
gggcagtgga

SEQ ID NO: 4254694 - DNA, 10 bp, Homo sapiens
gggcagtgga

SEQ ID NO: 4254695 - DNA, 12 bp, Homo sapiens
tcaagctcattc

SEQ ID NO: 4254696 - DNA, 9 bp, Homo sapiens
tggaaagtt

SEQ ID NO: 4254697 - DNA, 9 bp, Homo sapiens
tggagagtt

SEQ ID NO: 4254698 - DNA, 9 bp, Homo sapiens
tggagagtt

SEQ ID NO: 4254699 - DNA, 10 bp, Homo sapiens
tcactgcaac

SEQ ID NO: 4254700 - DNA, 12 bp, Homo sapiens
ccaggaagtgga

SEQ ID NO: 4254701 - DNA, 9 bp, Homo sapiens
agcctgggc

SEQ ID NO: 4254702 - DNA, 14 bp, Homo sapiens
cagcccgagcaaca

SEQ ID NO: 4254703 - DNA, 12 bp, Homo sapiens
ctccttgaggac

SEQ ID NO: 4254704 - DNA, 11 bp, Homo sapiens
cctgttgttca

SEQ ID NO: 4254705 - DNA, 8 bp, Homo sapiens
ctccacca

SEQ ID NO: 4254706 - DNA, 10 bp, Homo sapiens
gaagttcaga

SEQ ID NO: 4254707 - DNA, 7 bp, Homo sapiens
gctggaa

SEQ ID NO: 4254708 - DNA, 12 bp, Homo sapiens
ccaagaagtgga

SEQ ID NO: 4254709 - DNA, 9 bp, Homo sapiens
gggttttgt

SEQ ID NO: 4254710 - DNA, 7 bp, Homo sapiens
gaccaga

SEQ ID NO: 4254711 - DNA, 9 bp, Homo sapiens
taatgtgaa

SEQ ID NO: 4254712 - DNA, 9 bp, Homo sapiens
taatgtgag

SEQ ID NO: 4254713 - DNA, 9 bp, Homo sapiens
cccatgttt

SEQ ID NO: 4254714 - DNA, 10 bp, Homo sapiens
ctccttgagg

SEQ ID NO: 4254715 - DNA, 9 bp, Homo sapiens
taagttctg

SEQ ID NO: 4254716 - DNA, 10 bp, Homo sapiens
taagttctgc

SEQ ID NO: 4254717 - DNA, 9 bp, Homo sapiens
gaaggaagc

SEQ ID NO: 4254718 - DNA, 9 bp, Homo sapiens
taagaaaag

SEQ ID NO: 4254719 - DNA, 8 bp, Homo sapiens
ggtgctaa

SEQ ID NO: 4254720 - DNA, 11 bp, Homo sapiens
agtttgtcagt

SEQ ID NO: 4254721 - DNA, 12 bp, Homo sapiens
tggagcctgggc

SEQ ID NO: 4254722 - DNA, 7 bp, Homo sapiens
ggtccgt

SEQ ID NO: 4254723 - DNA, 7 bp, Homo sapiens
tctagac

SEQ ID NO: 4254724 - DNA, 7 bp, Homo sapiens
cactaaa

SEQ ID NO: 4254725 - DNA, 12 bp, Homo sapiens
ggttgtatggtt

SEQ ID NO: 4254726 - DNA, 10 bp, Homo sapiens
ccatattttg

SEQ ID NO: 4254727 - DNA, 11 bp, Homo sapiens
gtttgtacagt

SEQ ID NO: 4254728 - DNA, 7 bp, Homo sapiens
ctccacc

SEQ ID NO: 4254729 - DNA, 24 bp, Homo sapiens
aattgcttgaacccaggaagtgga

SEQ ID NO: 4254730 - DNA, 22 bp, Homo sapiens
actgcactccagcctgggctac

SEQ ID NO: 4254731 - DNA, 22 bp, Homo sapiens
cactgcactccagcccgagcaa

SEQ ID NO: 4254732 - DNA, 22 bp, Homo sapiens
ctagactgaagctccttgagga

SEQ ID NO: 4254733 - DNA, 22 bp, Homo sapiens
gaagtttgaagcctgttgttca

SEQ ID NO: 4254734 - DNA, 22 bp, Homo sapiens
tcactgcaacctccaccacgtg

SEQ ID NO: 4254735 - DNA, 22 bp, Homo sapiens
tcactgcaacctccaccagcct

SEQ ID NO: 4254736 - DNA, 22 bp, Homo sapiens
tctaagagaaaggaagttcaga

SEQ ID NO: 4254737 - DNA, 22 bp, Homo sapiens
gggcgtggagctggaatgatgt

SEQ ID NO: 4254738 - DNA, 22 bp, Homo sapiens
aatcacttgaacccaagaagtg

SEQ ID NO: 4254739 - DNA, 22 bp, Homo sapiens
agcaagaccagggttttgtgtt

SEQ ID NO: 4254740 - DNA, 21 bp, Homo sapiens
aggcagagaggaccagagact

SEQ ID NO: 4254741 - DNA, 22 bp, Homo sapiens
gggaaataattaatgtgaagtc

SEQ ID NO: 4254742 - DNA, 22 bp, Homo sapiens
aggaaaaaaattaatgtgagtc

SEQ ID NO: 4254743 - DNA, 18 bp, Homo sapiens
attcattgcccatgtttg

SEQ ID NO: 4254744 - DNA, 18 bp, Homo sapiens
tattcatgcccatggtga

SEQ ID NO: 4254745 - DNA, 22 bp, Homo sapiens
ctggactgagctccttgaggcc

SEQ ID NO: 4254746 - DNA, 22 bp, Homo sapiens
ttctgatggttaagttctgtca

SEQ ID NO: 4254747 - DNA, 22 bp, Homo sapiens
ttcaagtgtttaagttctgctt

SEQ ID NO: 4254748 - DNA, 21 bp, Homo sapiens
aggccaagaaggaagcagagg

SEQ ID NO: 4254749 - DNA, 18 bp, Homo sapiens
agtttgtgtaagaaaagc

SEQ ID NO: 4254750 - DNA, 22 bp, Homo sapiens
attaggagagtgggtgctaagt

SEQ ID NO: 4254751 - DNA, 23 bp, Homo sapiens
tggaggagagtttgtcagtatag

SEQ ID NO: 4254752 - DNA, 22 bp, Homo sapiens
cccgggtggagcctgggctgtg

SEQ ID NO: 4254753 - DNA, 22 bp, Homo sapiens
agggcaggaggtccgtcccttc

SEQ ID NO: 4254754 - DNA, 22 bp, Homo sapiens
gtgacagtgaatctagacagac

SEQ ID NO: 4254755 - DNA, 22 bp, Homo sapiens
ctcagctcatccactaaatccc

SEQ ID NO: 4254756 - DNA, 21 bp, Homo sapiens
ggaatggtggttgtatggttg

SEQ ID NO: 4254757 - DNA, 22 bp, Homo sapiens
tgatagatccatattttggtaa

SEQ ID NO: 4254758 - DNA, 22 bp, Homo sapiens
tgggttttgtttgtacagtgta

SEQ ID NO: 4254759 - DNA, 22 bp, Homo sapiens
tcactgcaacctccaccttccg

SEQ ID NO: 4254760 - DNA, 87 bp, Homo sapiens
cccgtgaggaacagtggcgggattgtcccagggccccttccagcagggggacctcctgacttgagagtccccaaagccttcccaggg

SEQ ID NO: 4254761 - DNA, 90 bp, Homo sapiens
ctccacctgtttgctagcataacaggcgtgaaggcggcagtgtcgccggcgtccttccgcggaagcccagtgtgtgcagacagcacgggg

SEQ ID NO: 4254762 - DNA, 60 bp, Homo sapiens
tgggttcctggcatgctgatttgtgacttaagattaaaatcacattgccagggattacca

SEQ ID NO: 4254763 - DNA, 126 bp, Homo sapiens
ggtcgcgctcactgcagattggagaacaggtgcatctcgtagctcttctttggaaaacaaaagaagccaccagctgaggaagatgctcaccggtcaccgtccctttatttatgcccagcgatgacc

SEQ ID NO: 4254764 - DNA, 74 bp, Homo sapiens
aggtgcaggagcttagctgattggtgaacagtgattggtttccgctttgttcacagtggctaagttctgcacct

SEQ ID NO: 4254765 - DNA, 88 bp, Homo sapiens
ctctaacaaggtgcaggagcttagctgattggtgaacagtgattggtttccgctttgttcacagtggctaagttctgcacctgaagag

SEQ ID NO: 4254766 - DNA, 81 bp, Homo sapiens
tggggacagttaagttggagccgctggggcagaggccgttgctgacgggccggccgctgctgcacagtcagcttgggtgcg

SEQ ID NO: 4254767 - DNA, 80 bp, Homo sapiens
ggtcaaatgtattgaaagttgcaaaaattcttcttacaaacataaagtgtgctgaatccactacgtaaaccaaaatcaaa

SEQ ID NO: 4254768 - DNA, 82 bp, Homo sapiens
ggctgtgagcggggcggggcggggctttcggaggagctcctgttgttctgggcgcggtgaactctctcttgtatttgcagtc

SEQ ID NO: 4254769 - DNA, 68 bp, Homo sapiens
ctccggtgcctactgagctgatatcagttctcattttacacactggctcagttcagcaggaacaggag

SEQ ID NO: 4254770 - DNA, 86 bp, Homo sapiens
tagcagctattgtgtacgcaaagcctgagtacagcctgctggtgtcatggccacgtgtgagcaggccagcgtcacacggctcgctg

SEQ ID NO: 4254771 - DNA, 705 bp, Homo sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 4254772 - DNA, 80 bp, Homo sapiens
gtgaggtagtaagttgtattgttgtggggtagggatattaggccccaattagaagataactatacaacttactactttcc

SEQ ID NO: 4254773 - DNA, 22 bp, Homo sapiens
tgaggtagtaagttgtattgtt

SEQ ID NO: 4254774 - DNA, 100 bp, Homo sapiens
gaggcaggagaattgcttgaacccaggaagtggaggcttcagtgagctgagaacacgccactgcactccagtcctgggcaacagagcaagactctgtctc

SEQ ID NO: 4254775 - DNA, 24 bp, Homo sapiens
aattgcttgaacccaggaagtgga

SEQ ID NO: 4254776 - DNA, 19 bp, Homo sapiens
aaaggaggagctctagata

SEQ ID NO: 4254777 - DNA, 22 bp, Homo sapiens
tggcctatagtgagtcgtatta

SEQ ID NO: 4254778 - DNA, 5 bp, Homo sapiens
ggcca

SEQ ID NO: 4254779 - DNA, 7 bp, Homo sapiens
tatctag

SEQ ID NO: 4254780 - DNA, 5 bp, Homo sapiens
atggc

SEQ ID NO: 4254781 - DNA, 5 bp, Homo sapiens
gccat

SEQ ID NO: 4254782 - DNA, 22 bp, Homo sapiens
tcactgcaacctccacctccca

SEQ ID NO: 4254783 - DNA, 22 bp, Homo sapiens
tcactgcaacctccacctcccg

SEQ ID NO: 4254784 - DNA, 22 bp, Homo sapiens
tcactgcaacctccacctcctg

SEQ ID NO: 4254785 - DNA, 22 bp, Homo sapiens
tcactgcaacctccaccttcag

SEQ ID NO: 4254786 - DNA, 22 bp, Homo sapiens
tcactgcaacctccaccttccg

SEQ ID NO: 4254787 - DNA, 18 bp, Homo sapiens
tttaaccgcatccttctc

SEQ ID NO: 4254788 - DNA, 20 bp, Homo sapiens
tactaatacgactcactaaa

SEQ ID NO: 4254789 - DNA, 30 bp, Homo sapiens
gactagctggaattcaaggatgcggttaaa

SEQ ID NO: 4254790 - DNA, 30 bp, Homo sapiens
cagccaacgctgcagatacgactcactaaa

SEQ ID NO: 4254791 - DNA, 50 bp, Homo sapiens
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 4254792 - DNA, 20 bp, Homo sapiens
ggaattcaaggatgcggtta

SEQ ID NO: 4254793 - DNA, 10 bp, Homo sapiens
  misc_feature (3)..(4): n is a, c, g or t
  misc_feature (8)..(9): n is a, c, g or t
ggnngggnng

SEQ ID NO: 4254794 - DNA, 12 bp, Homo sapiens
tttaaccgcatc

SEQ ID NO: 4254795 - DNA, 12 bp, Homo sapiens
cgactcactaaa

SEQ ID NO: 4254796 - DNA, 40 bp, Homo sapiens
taatacgactcactataggcccttattagaggattctgct

SEQ ID NO: 4254797 - DNA, 41 bp, Homo sapiens
aattaaccctcactaaaggtttttttttcctgagacagagt

SEQ ID NO: 4254798 - DNA, 42 bp, Homo sapiens
taatacgactcactatagggtgaggtagtaagttgtattgtt

SEQ ID NO: 4254799 - DNA, 41 bp, Homo sapiens
aattaaccctcactaaagggaaagtagtaagttgtatagtt

SEQ ID NO: 4254800 - DNA, 20 bp, Homo sapiens
gaggcaggagaattgcttga

SEQ ID NO: 4254801 - DNA, 39 bp, Homo sapiens
aattaaccctcactaaaggcctgagacagagtcttgctc

SEQ ID NO: 4254802 - DNA, 20 bp, Homo sapiens
attaaccctcactaaaggga

SEQ ID NO: 4254803 - DNA, 20 bp, Homo sapiens
taatacgactcactataggg

SEQ ID NO: 4254804 - DNA, 5 bp, Homo sapiens
ggcca

SEQ ID NO: 4254805 - DNA, 7 bp, Homo sapiens
tatctag

SEQ ID NO: 4254806 - DNA, 25 bp, Homo sapiens
  misc_feature (1)..(1): r is a or g
  misc_feature (3)..(3): r is a or g
  misc_feature (5)..(5): r is a or g
rtrgrgcctatagtgagtcgtatta

SEQ ID NO: 4254807 - DNA, 22 bp, Homo sapiens
  misc_feature (17)..(17): r is a or g
  misc_feature (19)..(19): r is a or g
  misc_feature (21)..(21): r is a or g
aaaggaggagctctagrartra

SEQ ID NO: 4254808 - DNA, 25 bp, Homo sapiens
  misc_feature (20)..(20): r is a or g
  misc_feature (22)..(22): r is a or g
  misc_feature (24)..(24): r is a or g
cctaggaggaggacgtctgrcrarg

SEQ ID NO: 4254809 - DNA, 25 bp, Homo sapiens
  misc_feature (1)..(1): r is a or g
  misc_feature (3)..(3): r is a or g
  misc_feature (5)..(5): r is a or g
rcrcrtatagtgagtcgtattatct

SEQ ID NO: 4254810 - DNA, 22 bp, Homo sapiens
taatacgactcactataggcca

SEQ ID NO: 4254811 - DNA, 34 bp, Homo sapiens
gctagcactagttaatacgactcactataggcca

SEQ ID NO: 4254812 - DNA, 19 bp, Homo sapiens
aaaggaggagctctagata

SEQ ID NO: 4254813 - DNA, 29 bp, Homo sapiens
tgacctgcagaaaggaggagctctagata

SEQ ID NO: 4254814 - DNA, 24 bp, Homo sapiens
atcctaggaggaggacgtctgcag

SEQ ID NO: 4254815 - DNA, 28 bp, Homo sapiens
gctctaggataatacgactcactatagg
